US012674153B2

(12) United States Patent (10) Patent No.: US 12,674,153 B2
Bailey et al. (45) Date of Patent: Jul. 7, 2026

(54) ACE2 MUTEINS AND METHODS OF USING THE SAME

(71) Applicant: EMMUNE, Inc., Cambridge, MA (US)

(72) Inventors: Charles C. Bailey, Jupiter, FL (US); Michael D. Alpert, Cambridge, MA (US)

(73) Assignee: Emmune, Inc., Cambridge, MA (US)

( * ) Notice: Subject to any disclaimer, the term of this patent is extended or adjusted under 35 U.S.C. 154(b) by 678 days.

(21) Appl. No.: 17/926,440

(22) PCT Filed: May 20, 2021

(86) PCT No.: PCT/US2021/033454
§ 371 (c)(1),
(2) Date: Nov. 18, 2022

(87) PCT Pub. No.: WO2021/236957
PCT Pub. Date: Nov. 25, 2021

(65) Prior Publication Data
US 2023/0183668 A1 Jun. 15, 2023

Related U.S. Application Data

(60) Provisional application No. 63/052,402, filed on Jul. 15, 2020, provisional application No. 63/027,884, filed on May 20, 2020.

(51) Int. Cl.
*C12N 9/48* (2006.01)
*A61K 31/4174* (2006.01)
*A61K 38/48* (2006.01)
*A61P 31/14* (2006.01)

(52) U.S. Cl.
CPC .......... *C12N 9/485* (2013.01); *A61K 31/4174* (2013.01); *A61K 38/4813* (2013.01); *A61P 31/14* (2018.01); *C12Y 304/17023* (2013.01); *C07K 2319/02* (2013.01); *C07K 2319/30* (2013.01)

(58) Field of Classification Search
CPC ................ A61K 38/4813; A61K 38/00; C07K 2319/00; C07K 2319/02; C07K 2319/30; C12N 9/485; C12Y 304/17023
See application file for complete search history.

(56) References Cited

U.S. PATENT DOCUMENTS

2023/0183668 A1* 6/2023 Bailey et al.

FOREIGN PATENT DOCUMENTS

| WO | WO-2002/12471 A2 | 12/2002 |
| WO | WO-2004023270 A2 | 3/2004 |
| WO | WO-2021188576 A1 | 9/2021 |

OTHER PUBLICATIONS

International Search Report issued in PCT/US2021/033454, mailed Nov. 24, 2021.
Written Opinion issued in PCT/US2021/033454, mailed Nov. 24, 2021.
Extended European Search Report issued in European Patent Application No. 21808254.3, mailed Mar. 3, 2025.
MacGowan et al., "Missense variants in ACE2 are predicted to encourage and inhibit interaction with SARS-CoV-2 Spike and contribute to genetic risk in COVID-19." BioRxiv, pp. 1-38 (2020).
AlGhamdi et al., "Emerging of composition variations of SARS-CoV-2 spike protein and human ACE2 contribute to the level of infection: in silico approaches" Journal of Biomolecular Structure and Dynamics,Â 40(6), pp. 2635-2646.
Lei, C et al., "Neutralization of SARS-CoV-2 spike pseudotyped virus by recombinant ACE2-Ig" Nature Communications 11(1):1-5, (2020).
Procko, The sequence of human ACE2 is suboptimal for binding the S spike protein of SARS coronavirus 2. bioRxiv [Preprint]. Mar. 17, 2020:2020.03.16.994236. doi: 10.1101/2020.03.16.994236.
Procko, The sequence of human ACE2 is suboptimal for binding the S spike protein of SARS coronavirus 2. bioRxiv [Preprint]. Apr. 6, 2020:2020.03.16.994236. doi: 10.1101/2020.03.16.994236.
Procko, The sequence of human ACE2 is suboptimal for binding the S spike protein of SARS coronavirus 2. bioRxiv [Preprint]. May 11, 2020:2020.03.16.994236. doi: 10.1101/2020.03.16.994236.
Chan et al., "Engineering human ACE2 to optimize binding to the spike protein of SARS coronavirus 2" Science 369, 1261-1265 (2020).
Xiao et al., "A trimeric human angiotensin-converting enzyme 2 as an anti-SARS-CoV-2 agent" Nat Struct Mol Biol. Feb. 28, 2021(2): 202-209.
Hofmann et al., "Susceptibility to SARS coronavirus S protein-driven infection correlates with expression of angiotensin converting enzyme 2 and infection can be blocked by soluble receptor" Biochemical and Biophysical Research Communications 319 (2004) 1216-1221.
Han et al., "Identification of critical determinants on ACE2 for SARS-CoV entry and development of a potent entry inhibitor" Virology (350): 15-25 (2006).
Yan et al., "Structural basis for the recognition of SARS-CoV-2 by full-length human ACE2" Science (367):1444-1448 (2020).
Angal et al., "A single amino acid substitution abolishes the heterogeneity of chimeric mouse/human (IgG4) antibody" Mol Immunol. 30(1):105-8 (1993).
Anselmo et al., "Nanoparticles in the clinic" Bioeng Transl Med. 1(1):10-29 (2016).
Cheng et al., "Scratch: a protein structure and structural feature prediction server" Nucleic Acids Research, (33):W73-W76 (2005).
Delport et al., "Determining the Protein Stability of Alzheimer's Disease Protein, Amyloid Precursor Protein" Protein J., 38(4):419-424 (2019).
Pugalenthi et al., "RSARF: prediction of residue solvent accessibility from protein sequence using random forest method" Protein Pept Lett, 19(1):50-6 (2012).

(Continued)

*Primary Examiner* — Tekchand Saidha
*Assistant Examiner* — Mohammad Y Meah
(74) *Attorney, Agent, or Firm* — Goodwin Procter LLP

(57) ABSTRACT

The invention relates generally to non-naturally occurring ACE2 proteins and their use in the treatment of coronavirus infection.

19 Claims, 60 Drawing Sheets

Specification includes a Sequence Listing.

(56)           References Cited

OTHER PUBLICATIONS

Henikoff et al., "Amino acid substitution matrices from protein blocks" Proc Natl Acad Sci, (89):10915-9 (1992).

Hofmann et al., "Human coronavirus NL63 employs the severe acute respiratory syndrome coronavirus receptor for cellular entry" Proc Natl Acad Sci, 102(22):7988-93 (2005).

Huentelman et al., "Structure-based discovery of a novel angiotensin-converting enzyme 2 inhibitor" Hypertension, 44(6):903-6 (2004).

Ringe et al., "Protein structure to function: insights from computation" Cell Mol Life Sci. 61(4):387-92 (2004).

Li et al., "Angiotensin-converting enzyme 2 is a functional receptor for the SARS coronavirus" Nature, 426(6965):450-4 (2003).

Liu et al., "A Fluorometric Method of Measuring Carboxypeptidase Activities for Angiotensin II and Apelin-13" Sci Rep, (7):45473 (2017).

Ma et al., "AcconPred: Predicting Solvent Accessibility and Contact Number Simultaneously by a Multitask Learning Framework under the Conditional Neural Fields Model" Biomed Res Int. Article ID 678764, 10 pages (2015).

Magnan et al., "SSpro/ACCpro 5: almost perfect prediction of protein secondary structure and relative solvent accessibility using profiles, machine learning and structural similarity" Bioinformatics, 30(18):2592-7 (2014).

Malik et al., "MERS-COV papain-like protease (PLpro): expression, purification, and spectroscopic/thermodynamic characterization" Biotech (2):100 (2017).

Moore et al., "Retroviruses pseudotyped with the severe acute respiratory syndrome coronavirus spike protein efficiently infect cells expressing angiotensin-converting enzyme 2" J. Virol, vol. 78(19):10628-35 (2004).

Niesen et al., The use of differential scanning fluorimetry to detect ligand interactions that promote protein stability Nat Protoc. 2(9):2212-21(2007).

Pauling et al., "Configurations of Polypeptide Chains With Favored Orientations Around Single Bonds: Two New Pleated Sheets" Proc Natl Acad Sci U S A. 37(11):729-40 (1951).

Bondugula et al., "Combining sequence and structural profiles for protein solvent accessibility prediction" Comput Syst Bioinformatics Conf. 7:195-202 (2008).

Simeonov., "Recent developments in the use of differential scanning fluorometry in protein and small molecule discovery and characterization" Expert Opin Drug Discov. 8(9):1071-82 (2013).

Towler et al., "ACE2 X-ray structures reveal a large hinge-bending motion important for inhibitor binding and catalysis" J Biol Chem. 279(17):17996-8007 (2004).

Willard et al., "VADAR: a web server for quantitative evaluation of protein structure quality" Nucleic Acids Res. 31(13):3316-9 (2003).

Heffernan et al., "Improving prediction of secondary structure, local backbone angles, and solvent accessible surface area of proteins by iterative deep learning" Sci Rep. 5:11476 (2015).

Zhang et al., "Next generation informatics for big data in precision medicine era" BioData Mining, 8:34, 3 pages (2015).

Zhou et al., "A pneumonia outbreak associated with a new coronavirus of probable bat origin" Nature 579 (7798):270-273 (2020).

Lei et al., "Potent neutralization of 2019 novel coronavirus by recombinant ACE2-Ig" bioRxiv, Feb. 2, 2020, pp. 1-11. bioRxiv preprint, doi: https://doi.org/10.1101/2020.02.01.929976.

* cited by examiner

FIGURE 1
A.
Substrate-binding cleft
ACE2
Hinge of Fc region
CH2/CH3 domains of Fc region
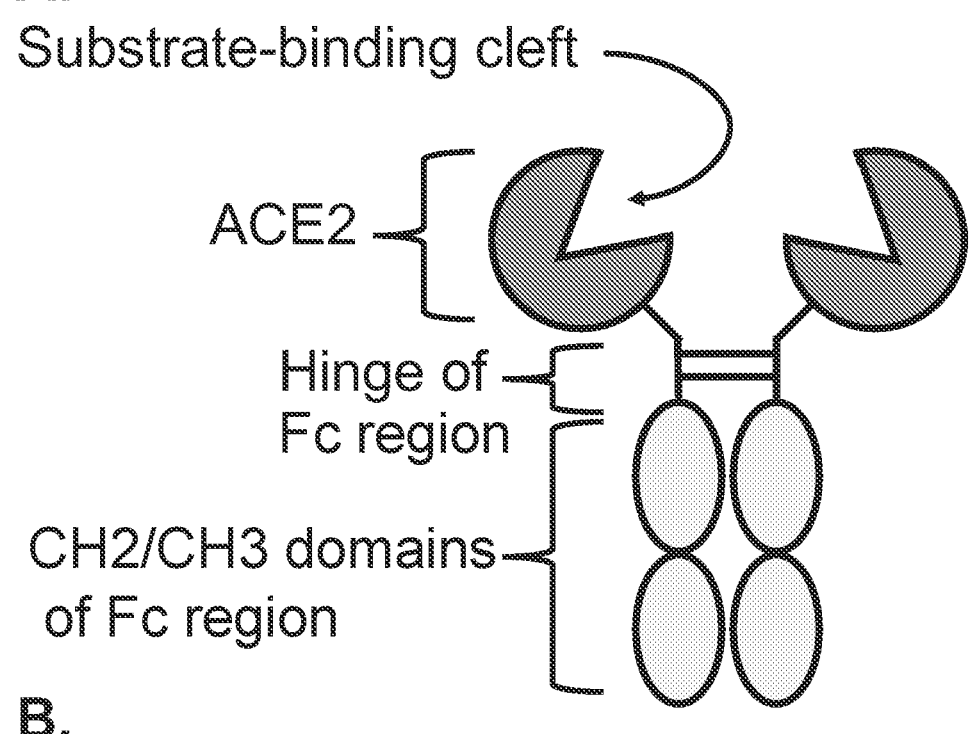
B.
Collectrin domain
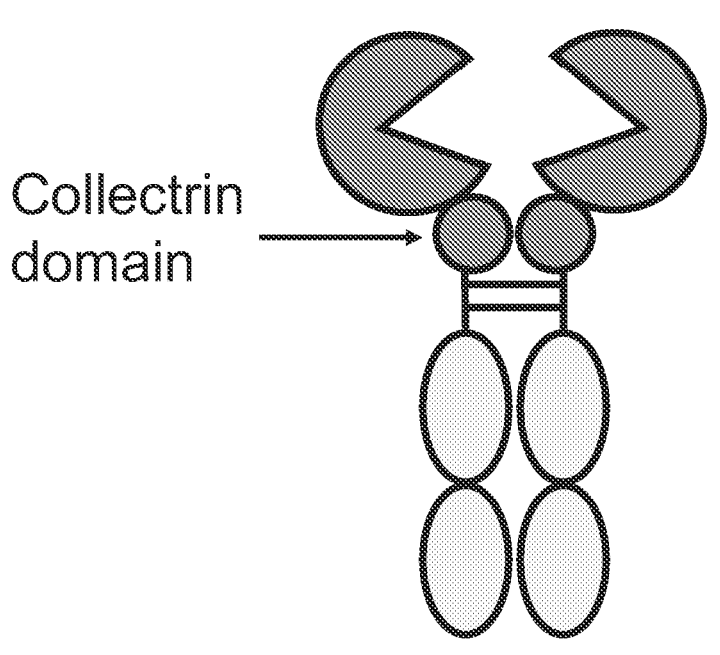

Apes

| Human | --MSSSWLLLSLVAVTAAQSTIEEQAKTFLDKFNH |
| Chimpanzee | --MSGSSWLLLSLVAVTAAQSTIEEQAKTFLDKFNH |
| Bonobo | --MSGSSWLLLSLVAVTAAQSTIEEQAKTFLDKFNH |
| Gorilla | --MSGSSWLLLSLVAVTAAQSTIEEQAKTFLDKFNH |
| Northern_white-cheeked_gibbon | --MSGSSWLLLSLVAVTAAQSTIEEQARTFLDKFNH |
| Sumatran_orangutan | --MSGSSWLLLSLVAVTAAQSTIEEQAKTFLDKFNH |

```
                              1s        10s        20s       30
                    1234567890123456789012345678901234
```

Old World Monkeys

| Red_colobus_monkey | --MSGSSWLLFSLVAVTAAQSTIEEQAKTFLDKFNH |
| Golden_snub-nosed_monkey | --MSGSSWLLLSLVAVTAAQSTIEEQAKTFLDKFNH |
| Black_snub-nosed_monkey | |
| African_green_monkey | --MSGSSWLLLSLVAVTAAQSTIEEQAKTFLDKFNH |
| Sooty_mangabey | --MSGSSWLLLSLVAVTAAQSTIEEQAKTFLDKFNH |
| Mandrill | --MSGSSWLLLSLVAVTAAQSTIEEQAKTFLDKFNH |
| Rhesus_macaque | --MSGSSWLLLSLVAVTAAQSTIEEQAKTFLDKFNH |
| Pig-tailed_macaque (nemestrina) | --MSGSSWLLLSLVAVTAAQSTIEEQAKTFLDKFNH |
| Crab-eating_macaque (fascicularis) | --MSGSSWLLLSLVAVTAAQSTIEEQAKTFLDKFNH |
| Gelada_baboon | --MSGSSWLLLSLVAVTAAQSTIEEQAKTFLDKFNH |
| Olive_baboon | --MSGSSWLLLSLVAVTAAQSTIEEQAKTFLDKFNH |

```
                              1s        10s        20s       30
                    1234567890123456789012345678901234
```

New World Monkeys

| white-tufted-ear_marmoset | ---SGSFWLLLSLVAVTAAQSTIEEQAKTFLDKFNH |
| Bolivian_squirrel_monkey | --MSGSFWLLLSLVAVIAAQSTIEEQAKTFLDKFNH |
| Ma's_night_monkey | --MSGSFWLLLSLVAVTAAQSTIEEQAKTFLDKFNH |
| White-faced_capuchin | --MSGSFWLLLSLVAVTAAQSTIEEQAKTFLDKFNH |
| Tufted_capuchin | --MSGSFWLLLSLVAVTAAQSTVEEQAKTFLDKFNH |

```
                              1s        10s        20s       30
                    1234567890123456789012345678901234
```

Prosimians

| Tarsier | --MSGSSWLLLSLVVVTAAQSTPEEQVKTFLDKFNQ |
| Galago | --MSSFWLLLSLVAVTAAQSTTEEQAKTFLDNFNR |
| gray_mouse_lemur | MRENLMRRFYSRERLFSGCDLGSPGKMSSSFWLLLSLISVTAAQSTTEEQAKTFLENFNN |
| Coquerel's_sifaka | -----MRRFYSRERLFSGCDLGSPGKMSSSFWLLLSLISVTAAQSTTEEQAKTFLDKFNH |

```
                  40s       50s       60s       70s       80s      90
         5678901234567890123456789012345678901234567890123456789012345678901234
Apes
Human                      EAEDLFYQSSLASWNYNTNITEENVQNMNNAGDKWSAFLKEQSTLAQMYPLQEIQNLTVK
Chimpanzee                 EAEDLFYQSSLASWNYNTNITEENVQNMNNAGDKWSAFLKEQSTLAQMYPLQEIQNLTVK
Bonobo                     EAEDLFYQSSLASWNYNTNITEENVQNMNNAGDKWSAFLKEQSTLAQMYPLQEIQNLTVK
Gorilla                    EAEDLFYQSSLASWNYNTNITEENVQNMNNAGDKWSAFLKEQSTLAQMYPLQEIQNLTIK
Northern_white-cheeked_gibbon  EAEDLFYQSSLASWNYNTNITEENVQNMNNAGDKWSAFLKEQSTLAQMYPLQEIQNLTIK
Sumatran_orangutan         EAEDLFYQSSLASWNYNTNITEENVQNMNNAGDKWSAFLKEQSTLAQMYPLQEIQNLTVK 40s       50s       60s       70s       80s      90
         5678901234567890123456789012345678901234567890123456789012345678901234
Old World Monkeys
Red_colobus_monkey             EAEDLFYQSSLASWNYNTNITEENAQNMNNAGEKWSAFLKEQSTLAQMYPLQEIQNLTVK
Golden_snub-nosed_monkey       EAEDLFYQSSLASWNYNTNITEENVQNMNNAGDKWSAFLKEQSTLAQMYPLQEIQNLTVK
Black_snub-nosed_monkey        ------------------------------------MYPLQEIQNLTVK
African_green_monkey           EAEDLFYQSSLASWNYNTNITEENVQNMNNAGEKWSAFLKEQSTLAQMYPLQAIQNLTVK
Sooty_mangabey                 EAEDLFYQSSLASWNYNTNITEENVQNMNNAGEKWSAFLKEQSALAQMYPLQEIQNLTVK
Mandrill                       EAEDLFYQSSLASWNYNTNITEENVQNMNNAGEKWSAFLKEQSALAQMYPLQEIQNLTVK
Rhesus_macaque                 EAEDLFYQSSLASWNYNTNITEENVQNMNNAGEKWSAFLKEQSTLAQMYPLQEIQNLTVK
Pig-tailed_macaque (nemestrina)    EAEDLFYQSSLASWNYNTNITEENVQNMNNAGEKWSAFLKEQSTLAQMYPLQEIQNLTVK
Crab-eating_macaque (fascicularis) EAEDLFYQSSLASWNYNTNITEENVQNMNNAGEKWSAFLKEQSTLAQMYPLQEIQNLTVK
Gelada_baboon                  EAEDLFYQSSLASWNYNTNITEENVQNMNNAGEKWSAFLKEQSALAQMYPLQEIQNLTVK
Olive_baboon                   EAEDLFYQSSLASWNYNTNITEENVQNMNNAGEKWSAFLKEQSALAQMYPLQEIQNLTVK 40s       50s       60s       70s       80s      90
         5678901234567890123456789012345678901234567890123456789012345678901234
New World Monkeys
white-tufted-ear_marmoset      EAEDLFHENSLASWNYNTNITEENVQNMNVAGEKWFAFFKEQSKLAQTYPLQEIQNLTVK
Bolivian_squirrel_monkey       EAEDLFHENSLASWNYNTNITEENVQNMNVAGEKWSAFFKEQSKLAQTYPLQEIQNLTVK
Ma's_night_monkey              EAEDLFHENSLASWNYNTNITEENVQNMNVAGEKWSDFFKEQSKLAQTYPLQEIQNLTVK
White-faced_capuchin           EAEDLFHENSLASWNYNTNITEENVQNMNVAGEKWSAFFKEQSKLAQTYPLKEIQNLTVK
Tufted_capuchin                EAEDLFHENSLASWNYNTNITEENVQNMNVAGEKWSAFFKEQSKLAQTYPLKEIQNLTVK 40s       50s       60s       70s       80s      90
         5678901234567890123456789012345678901234567890123456789012345678901234
Prosimians
Tarsier                        EAEDLYHQSSLAAWNYNTNITEENSQQMNDAGEIWSAFYNEQSKIAQSYPIQEIQNSTIK
Galago                         EVEELSHQAALASWDYNTNITEENAQKMNDAEAKRSAFYEEQSKISQTYPLEEIQNRTVK
gray_mouse_lemur               EAEDLSHQSALASWDYNTNITEENAQKMSDHGAKWSAFYEEQSKLAQTYPLEAIQNLTIK
Coquerel's_sifaka              EAEDLSYQSALASWDYNTNITEENAQKMNDYGDKLSAFYEEQSKLAQTYPLEEIQNVTVK
```

Apes

| Species | Sequence |
|---|---|
| Human | LQLQALQQNGSSVLSEDKSK---RLNTILNTMSTIYSTGKVCNPDNPQECLLLEPGLNEIM |
| Chimpanzee | LQLQALQQNGSSVLSEDKSK---RLNTILNTMSAIYSTGKVCNPNNPQECLLLEPGLNEIM |
| Bonobo | LQLQALQQNGSSVLSEDKSK---RLNTILNTMSAIYSTGKVCNPNNPQECLLLEPGLNEIM |
| Gorilla | LQLQALQQNGSSVLSEDKSK---RLNTILNTMSTIYSTGKVCNPNNPQECLLLEPGLNEIM |
| Northern white-cheeked gibbon | LQLQALQQNGSSVLSEDKSK---RLNTILNTMSTIYSTGKVCNPNNPQECLLLEPGLNEIM |
| Sumatran orangutan | LQLQALQQNGSSVLSEDKSK---RLNTILNTMSTIYSTGKVCNPNNPQECLLLEPGLNEIM |

```
                100s      110s       120s       130s       140s
       567890123456789012345678901234567890123456789012345678901234567890123456789012
```

Old World Monkeys

| Species | Sequence |
|---|---|
| Red_colobus_monkey | LQLQALQQNGSSVLSEDKSK---RLNTILNTMSTIYSTGKVCNPNNPQECLLLDPGLNEIM |
| Golden_snub-nosed_monkey | LQLQALQQNGSSVLSEDKSK---RLNTILNTMSTIYSTGKVCNPNNSQECLLLDPGLNEIM |
| Black_snub-nosed_monkey | LQLQALQQNGSSVLSEDKSK---RLNTILNTMSTIYSTGKVCNPNNSQKCLLLDPGLNEIM |
| African_green_monkey | LQLQALQQNGSSVLSEDKSK---RLNTILNTMSTIYSTGKVCNPNNPQECLLLDPGLNEIM |
| Sooty_mangabey | LQLQALQQNGSSVLSEDKSK---RLNTILNTMSTIYSTGKVCNPNNPQECLLLDPGLNEIM |
| Mandrill | LQLQALQQNGSSVLSEDKSK---RLNTILNTMSTIYSTGKVCNPNNPQECLLLDPGLNEIM |
| Rhesus_macaque | LQLQALQQNGSSVLSEDKSK---RLNTILNTMSTIYSTGKVCNPNNPQECLLLDPGLNEIM |
| Pig-tailed_macaque (nemestrina) | LQLQALQQNGSSVLSEDKSK---RLNTILNTMSTIYSTGKVCNPNNPQECLLLDPGLNEIM |
| Crab-eating_macaque (fascicularis) | LQLQALQQNGSSVLSEDKSK---RLNTILNTMSTIYSTGKVCNPNNPQECLLLDPGLNEIM |
| Gelada_baboon | LQLQALQQNGSSVLSEDKSK---RLNTILNTMSTIYSTGKVCNPNNPQECLLLDPGLNEIM |
| Olive_baboon | LQLQALQQNGSSVLSEDKSK---RLNTILNTMSTIYSTGKVCNPNNPQECLLLDPGLNEIM |

```
                100s      110s       120s       130s       140s
       567890123456789012345678901234567890123456789012345678901234567890123456789012
```

New World Monkeys

| Species | Sequence |
|---|---|
| white-tufted-ear_marmoset | LQLQALQQNGSSVLSEDKSQ--QLNIIINTMSTIYSTGKVCKPNYPQECLLLEPDLNEIM |
| Bolivian_squirrel_monkey | LQLQALQQNGSSVLSEDKSK--RLNIIINAMSTIYSTGKVCNPNHPQECLLLEPGLNEIM |
| Ma's_night_monkey | LQLQALQQNGSSVLSEDKSK---RLNTIINTMSTIYSIGKVCNPNYPQECLLLEPGLNEIM |
| White-faced_capuchin | LQLQALQQNGSSVLSEDKSK---RLNTIINTMSTIYSTGKVCNPNYPQECLLLEPGLNEIM |
| Tufted_capuchin | LQLQALQQNGSSVLSEDKSK---RLNTIINTMSTIYSTGKVCNPNYPQECLLLEPGLNEIM |

```
                100s      110s       120s       130s       140s
       567890123456789012345678901234567890123456789012345678901234567890123456789012
```

Prosimians

| Species | Sequence |
|---|---|
| Tarsier | RQLQALQYNGSSVLSEDKRK---RLNTILSTMSTIYSTGKVCNPNNPQDCLVLTPGLDDIM |
| Galago | RQLKALQQRGSSALPADKNK---RLSTILNTMSTIYSTGKVCNSNNPQECLLLEPGLEAIM |
| gray_mouse_lemur | RQLRVLQQSGSGLSADKNK---QLNTILNTMSTIYSTGKVCNPNNPQDCLLLEPGLDTIM |
| Coquerel's_sifaka | RQLQALQQSGSGLSADKSK---QLNTILSTMSTMYSTGTVCNPNNPQECLLLEPGLDTIM |

Apes

```
          150s      160s      170s      180s      190s      200s
     3456789012345678901234567890123456789012345678901234567890123456789012
Human                          ANSLDYNERLWAWESWRSEVGKQLRPLYEEYVVLKNEMARANHYEDYGDYWRGDYEVNGV
Chimpanzee                     ANSLDYNERLWAWESWRSEVGKQLRPLYEEYVVLKNEMARANHYEDYGDYWRGDYEVNGV
Bonobo                         ANSLDYNERLWAWESWRSEVGKQLRPLYEEYVVLKNEMARANHYEDYGDYWRGDYEVNGV
Gorilla                        ANSLDYSERLWAWESWRSEVGKQLRPLYEEYVVLKNEMARANHYEDYGDYWRGDYEVNGV
Northern_white-cheeked_gibbon  ANSLDYSERLWAWESWRSEVGKQLRPLYEEYVVLKNEMARANHYEDYGDYWRGDYEVNGV
Sumatran_orangutan             ANSLDYNERLWAWESWRSEVGKQLRPLYEEYVVLKNEMARANHYEDYGDYWRGDYEVNGV
```

Old World Monkeys

```
                                  150s      160s      170s      180s      190s      200s
                              3456789012345678901234567890123456789012345678901234567890123456789012
Red_colobus_monkey                EKSLDYNERLWAWEGWRSEVGKQLRPLYEEYVVLKNEMARANHYKDYGDYWRGDYEANGV
Golden_snub-nosed_monkey          EKSLDYNERLWAWEGWRSEVGKQLRPLYEEYVVLKNEMARANHYKDYGDYWRGDYEVNGV
Black_snub-nosed_monkey           EKSLDYNERLWAWEGWRSEVGKQLRPLYEEYVVLKNEMARANHYKDYGDYWRGDYEANGV
African_green_monkey              EKSLDYNERLWAWEGWRSEVGKQLRPLYEEYVVLKNEMARANHYKDYGDYWRGDYEVNGV
Sooty_mangabey                    EKSLDYNERLWAWEGWRSEVGKQLRPLYEEYVVLKNEMARANHYKDYGDYWRGDYEVNGV
Mandrill                          EKSLDYNERLWAWEGWRSEVGKQLRPLYEEYVVLKNEMARANHYKDYGDYWRGDYEVNGV
Rhesus_macaque                    EKSLDYNERLWAWEGWRSEVGKQLRPLYEEYVVLKNEMAGANHYKDYGDYWRGDYEVNGV
Pig-tailed_macaque (nemestrina)   EKSLDYNERLWAWEGWRSEVGKQLRPLYEEYVVLKNEMARANHYKDYGDYWRGDYEVNGV
Crab-eating_macaque (fascicularis)EKSLDYNERLWAWEGWRSEVGKQLRPLYEEYVVLKNEMARANHYKDYGDYWRGDYEVNGV
Gelada_baboon                     EKSLDYNERLWAWEGWRSEVGKQLRPLYEEYVVLKNEMARANHYKDYGDYWRGDYEVNGV
Olive_baboon                      EKSLDYNERLWAWEGWRSEVGKQLRPLYEEYVVLKNEMARANHYKDYGDYWRGDYEVNGV
```

New World Monkeys

```
                             150s      160s      170s      180s      190s      200s
                         3456789012345678901234567890123456789012345678901234567890123456789012
white-tufted-ear_marmoset    AKSTDYNERLWAWESWRSEIGKQLRPLYEEYVVLKNEMARANHYEDYGDYWRGDYEVNGV
Bolivian_squirrel_monkey     AKSTDYNERLWAWEGWRSEVGKQLRPLYEEYVVLKNEMARANHYEDYGDYWRGDYEVNGV
Ma's_night_monkey            AKSTDYNERLWAWEGWRSEIGKQLRPLYEEYVVLKNEMARANHYEDYGDYWRGDYEVNGV
White-faced_capuchin         AKSTDYNERLWAWEGWRSEVGKQLRPLYEEYVVLKNEMARANHYEDYGDYWRGDYEVNGV
Tufted_capuchin              AKSTDYNERLWAWEGWRSEVGKQLRPLYEEYVVLKNEMARANHYEDYGDYWRGDYEVNGV
```

Prosimians

```
                       150s      160s      170s      180s      190s      200s
                   3456789012345678901234567890123456789012345678901234567890123456789012
Tarsier                AQSTDYSKRLWVWEGWRSEIGKQLRPLYEEVDLKNEMARANGYEDYGDYWRGDYAAEGV
Galago                 ANSRDYNERLWAWEGWRAEVGKQLRPLYEEYVDLKNEMARANNYEDYGDYWRADYDAEGE
gray_mouse_lemur       ANSRDYSQRLWAWEGWRSEVGKQLRPLYEEYVVLKNEMARANNYEDYGDYWRADYEAEGE
Coquerel's_sifaka      ANSRDYSERLWAWEGWRSEVGKQLRPLYEEYVVLKNEMARANNYEDYGDYWRADYEAEGE
```

Apes

```
Human                          DGYDYSRGQLIEDVEHTFEEIKPLYEHLHAYVRAKLMNAYPSYISPIGCLPAHLLGDMWG
Chimpanzee                     DGYDYSRGQLIEDVEHTFEEIKPLYEHLHAYVRAKLMNAYPSYISPIGCLPAHLLGDMWG
Bonobo                         DGYDYSRGQLIEDVEHTFEEIKPLYEHLHAYVRAKLMNAYPSYISPIGCLPAHLLGDMWG
Gorilla                        DGYDYSRGQLIEDVEHTFEEIKPLYEHLHAYVRAKLMNAYPSYISPIGCLPAHLLGDMWG
Northern_white-cheeked_gibbon  DGYDYSRGQLIEDVEHTFEEIKPLYEHLHAYVRAKLINAYPSYISPIGCLPAHLLGDMWG
Sumatran_orangutan             DSYDYSRGQLIEDVEHTFEEIKPLYEHLHAYVRAKLINAYPSYISPIGCLPAHLLGDMWG
```

```
                                    210s      220s      230s      240s      250s      260s
                          3456789012345678901234567890123456789012345678901234567890012
```

Old World Monkeys

```
Red_colobus_monkey             DGYDYNRDQLIEDVEHTFEEIKPLYEHLHAYVRAKLMNAYPSYISPTGCLPAHLLGDMWG
Golden_snub-nosed_monkey       DGYDYNRDQLIEDVEHTFEEIKPLYEHLHAYVRAKLMNAYPSYISPTGCLPAHLLGDMWG
Black_snub-nosed_monkey        DGYDYNRDQLIEDVEHTFEEIKPLYEHLHAYVRAKLMNAYPSYISPTGCLPAHLLGDMWG
African_green_monkey           DGYDYNRDQLIEDVEHTFEEIKPLYEHLHAYVRAKLMNAYPSYISPTGCLPAHLLGDMWG
Sooty_mangabey                 DGYDYTRDQLIEDVERTFEEIKPLYEHLHAYVRAKLMNAYPSYISPTGCLPAHLLGDMWG
Mandrill                       DGYDYNRDQLIEDVERTFEEIKPLYEHLHAYVRAKLMNAYPSYISPTGCLPAHLLGDMWG
Rhesus_macaque                 DGYDNNRDQLIEDVERTFEEIKPLYEHLHAYVRAKLMNAYPSYISPTGCLPAHLLGDMWG
Pig-tailed_macaque (nemestrina)   DGYDYNRDQLIEDVERTFEEIKPLYEHLHAYVRAKLMNAYPSYISPTGCLPAHLLGDMWG
Crab-eating_macaque (fascicularis)   DGYDYNRDQLIEDVERTFEEIKPLYEHLHAYVRAKLMNAYPSYISPTGCLPAHLLGDMWG
Gelada_baboon                  DGYDYNRDQLIEDVERTFEEIKPLYEHLHAYVRAKLMNAYPSYISPTGCLPAHLLGDMWG
Olive_baboon                   DGYDYNRDQLIEDVERTFEEIKPLYEHLHAYVRAKLMNAYPSYISPTGCLPAHLLGDMWG
```

```
                                    210s      220s      230s      240s      250s      260s
                          3456789012345678901234567890123456789012345678901234567890012
```

New World Monkeys

```
white-tufted-ear_marmoset      DGYDYYRNQLIEDVERTFEEIKPLYEHLHAYVRTKLMNAYPSYISPTGCLPAHLLGDMWG
Bolivian_squirrel_monkey       DGYDYHRNQLIEDVERTFEEIKPLYEHLHAYVRAKLMNAYPSYISPIGCLPAHLLGDMWG
Ma's_night_monkey              DGYDYYRNQLIEDVERTFEEIKPLYEHLHAYVRAKLMNAYPSYISPTGCLPAHLLGDMWG
White-faced_capuchin           DGYDYYRNQLIEDVERTFEEIKPLYEHLHAYVRAKLMNVYPSYISPTGCLPAHLLGDMWG
Tufted_capuchin                DGYDYYRNQLIEDVERTFEEIKPLYEHLHAYVRAKLMNVYPSYISPTGCLPAHLLGDMWG
```

```
                                    210s      220s      230s      240s      250s      260s
                          3456789012345678901234567890123456789012345678901234567890012
```

Prosimians

```
Tarsier                        DGYDYNSTQLIEDVEHTFEQIKPLYEQLHAYVRGKLMNAYPSRISPTGCLPAHLLGDMWG
Galago                         DGYGYNRSQLIEDVEHIFTQVKPLYEQLHAYVRTKLMNAYPSRVSPTGCLPAHLLGDMWG
gray_mouse_lemur               SGYNYNRSQLMEDVEHTFAQIKPLYEHLHAYVRAKLMNVYPSHINPNGCLPAHLLGDMWG
Coquerel's_sifaka              NGYNYNRSQLIEDVESTFAQIKPLYEHLHAYVRAKLMNAYPSHISPTGCLPAHLLGDMWG
```

```
                    270s      280s      290s      300s      310s      320s
               3456789012345678901234567890123456789012345678901234567890123456789012
Apes
Human                          RFWTNLIYSLITVPFGQKPNIDVTDAMVDQAWDAQRIFKEAEKFFVSVGLPNMTQGFWENSM
Chimpanzee                     RFWTNLIYSLITVPFGQKPNIDVTDAMVDQAWDAQRIFKEAEKFFVSVGLPNMTQGFWENSM
Bonobo                         RFWTNLIYSLITVPFGQKPNIDVTDAMVDQAWDAQRIFKEAEKFFVSVGLPNMTQGFWENSM
Gorilla                        RFWTNLIYSLITVPFGQKPNIDVTDAMVDQAWDAQRIFKEAEKFFVSVGLPNMTQGFWENSM
Northern_white-cheeked_gibbon  RFWTNLIYSLITVPFGQKPNIDVTDAMVDQAWDAQRIFKEAEKFFVSVGLPNMTQGFWENSM
Sumatran_orangutan             RFWTNLIYSLITVPFGQKPNIDVTDAMVDQAWDAQRIFKEAEKFFVSVGLPNMTQRFWENSM 270s      280s      290s      300s      310s      320s
               3456789012345678901234567890123456789012345678901234567890123456789012
Old World Monkeys
Red_colobus_monkey                  RFWTNLIYSLITVPFGQKPNIDVTDAMVNQAWNAQRIFKEAEKFFVSVGLPNMTQGFWENSM
Golden_snub-nosed_monkey            RFWTNLIYSLITVPFGQKPNIDVTDAMVNQAWNAQRIFKEAEKFFVSIGLPNMTRGFWENSM
Black_snub-nosed_monkey             RFWTNLIYSLITVPFGQKPNIDVTDAMVNQAWNAQRIFKEAEKFFVSIGLPNMTRGFWENSM
African_green_monkey                RFWTNLIYSLITVPFGQKPNIDVTDAMVNQAWNAQRIFKEAEKFFVSVGLPNMTQGFWENSM
Sooty_mangabey                      RFWTNLIYSLITVPFGQKPNIDVTDAMVNQAWNAQRIFKEAEKFFVSVGLPNMTQGFWENSM
Mandrill                            RFWTNLIYSLITVPFGQKPNIDVTDAMVNQAWNAQRIFKEAEKFFVSVGLPNMTQGFWENSM
Rhesus_macaque                      RFWTNLIYSLITVPFGQKPNIDVTDAMVNQAWNAQRIFKEAEKFFVSVGLPNMTQGFWENSM
Pig-tailed_macaque (nemestrina)     RFWTNLIYSLITVPFGQKPNIDVTDAMVNQAWNAQRIFKEAEKFFVSVGLPNMTQGFWENSM
Crab-eating_macaque (fascicularis)  RFWTNLIYSLITVPFGQKPNIDVTDAMVNQAWNAQRIFKEAEKFFVSVGLPNMTQGFWENSM
Gelada_baboon                       RFWTNLIYSLITVPFGQKPNIDVTDAMVNQAWNAQRIFKEAEKFFVSVGLPNMTQGFWENSM
Olive_baboon                        RFWTNLIYSLITVPFGQKPNIDVTDAMVNQAWNAQRIFKEAEKFFVSVGLPNMTQGFWENSM 270s      280s      290s      300s      310s      320s
               3456789012345678901234567890123456789012345678901234567890123456789012
New World Monkeys
white-tufted-ear_marmoset   RFWTNLIYSLITVPFGQKPNIDVTDEMVKQAWDAQRIFKEAEKFFASVGLPNMTQGFWENSM
Bolivian_squirrel_monkey    RFWTNLIYSLITVPYGQKPNIDVTDEMVNQAWDARRIFKEAEKFFASVGLPNMTQGFWENSM
Ma's_night_monkey           RFWTNLIYSLITVPFGQKPNIDVTDEMVKQAWDAQRIFKEAEKFFASVGLPNMTQGFWENSM
White-faced_capuchin        RFWTNLIYSLITVPFGQKPNIDVTDEMVKQAWDARRIFKEAEKFFASVGLPNMTQGFWENSM
Tufted_capuchin             RFWTNLIYSLITVPFGQKPNIDVTDEMVKQAWDAQRIFKEAEKFFASVGLPNMTQGFWENSM 270s      280s      290s      300s      310s      320s
               3456789012345678901234567890123456789012345678901234567890123456789012
Prosimians
Tarsier             RFWTNLIYSLITVPFFEQKPNIDVTETMVNQAWDAQKIFREAEKFFTSVGLPNMTQEFWVNSV
Galago              RFWTNLIYSLAVPFFEQKPNIDVTDAMVNQGWDAQRIFKEAEDFFVTVSLPEMTQGFWQNSM
gray_mouse_lemur    RFWTNLIYSLITVPFEQKPNIDVTDAMVNQAWDANRILKEAENFFVSVGLPNMTQGFWEKSM
Coquerel's_sifaka   RFWTNLIYSLITVPFEQKPNIDVTDAMVNQAWDAKRIFKEAENFFVSVGLPNMTQGFWENSM
```

```
                                330s      340s      350s      360s      370s      380s
                                3456789012345678901234567890123456789012345678901234567890123456789012
Apes
Human                           LTDPGNVQKAVCHPTAWDLGKGDFRILMCTKVTMDDFLTAHHEMGHIQYDMAYAAQPFLL
Chimpanzee                      LTDPGNVQKAVCHPTAWDLGKGDFRILMCTKVTMDDFLTAHHEMGHIQYDMAYAAQPFLL
Bonobo                          LTDPGNVQKAVCHPTAWDLGKGDFRILMCTKVTMDDFLTAHHEMGHIQYDMAYAAQPFLL
Gorilla                         LTDPGNVQKAVCHPTAWDLGKGDFRILMCTKVTMDDFLTAHHEMGHIQYDMAYAAQPFLL
Northern_white-cheeked_gibbon   LTDPGNVQKVVCHPTAWDLGKGDFRILMCTKVTMDDFLTAHHEMGHIQYDMAYAAQPFLL
Sumatran_orangutan              LTDPGNVQKVVCHPTAWDLGKGDFRILMCTKVTMDDFLTAHHEMGHIQYDMAYAAQPFLL
```

```
                                330s      340s      350s      360s      370s      380s
                                3456789012345678901234567890123456789012345678901234567890123456789012
Old World Monkeys
Red_colobus_monkey              LTDPGDVQKVVCHPTAWDLGKGDFRILMCTKVTMDDFLTAHHEMGHIQYDMAYAAQPFLL
Golden_snub-nosed_monkey        LTDPGNVQKVVCHPTAWDLGKGDFRIIMCTKVTMDDFLTAHHEMGHIQYDMAYAAQPFLL
Black_snub-nosed_monkey         LTDPGNVQKVVCHPTAWDLGKGDFRIIMCTKVTMDDFLTAHHEMGHIQYDMAYAAQPFLL
African_green_monkey            LTDPGNVQKVVCHPTAWDLGKGDFRIIMCTKVTMDDFLTAHHEMGHIQYDMAYAAQPFLL
Sooty_mangabey                  LTDPGNVQKVVCHPTAWDLGKGDFRIIMCTKVTMDDFLTAHHEMGHIQYDMAYAAQPFLL
Mandrill                        LTDPGNVQKVVCHPTAWDLGKGDFRIIMCTKVTMDDFLTAHHEMGHIQYDMAYAAQPFLL
Rhesus_macaque                  LTDPGNVQKVVCHPTAWDLGKGDFRIIMCTKVTMDDFLTAHHEMGHIQYDMAYAAQPFLL
Pig-tailed_macaque (nemestrina) LTDPGNVQKVVCHPTAWDLGKGDFRIIMCTKVTMDDFLTAHHEMGHIQYDMAYAAQPFLL
Crab-eating_macaque (fascicularis) LTDPGNVQKVVCHPTAWDLGKGDFRIIMCTKVTMDDFLTAHHEMGHIQYDMAYAAQPFLL
Gelada_baboon                   LTDPGNVQKVVCHPTAWDLGKGDFRIIMCTKVTMDDFLTAHHEMGHIQYDMAYAAQPFLL
Olive_baboon                    LTDPGNVQKVVCHPTAWDLGKGDFRIIMCTKVTMDDFLTAHHEMGHIQYDMAYAAQPFLL
```

```
                                330s      340s      350s      360s      370s      380s
                                3456789012345678901234567890123456789012345678901234567890123456789012
New World Monkeys
white-tufted-ear_marmoset       LTEPGDGQKVVCHPTAWDLGKQDFRILMCTKTTMDDFLTAHHEMGHIQYDMAYAAQPFLL
Bolivian_squirrel_monkey        LTEPGDGQKVVCHPTAWDLGKQDFRILMCTKTTMDDFLTAHHEMGHIQYDMAYAAQPFLL
Ma's_night_monkey               LTEPGDGQKVVCHPTAWDLGKQDFRILMCTKTTMDDFLTAHHEMGHIQYDMAYAAQPFLL
White-faced_capuchin            LTEPGDGQKVVCHPTAWDLGKQDFRILMCTKTTMDDFLTAHHEMGHIQYDMAYAAQPFLL
Tufted_capuchin                 LTEPGDGQKVVCHPTAWDLGKQDFRILMCTKTTMDDFLTAHHEMGHIQYDMAYAAQPFLL
```

```
                                330s      340s      350s      360s      370s      380s
                                3456789012345678901234567890123456789012345678901234567890123456789012
Prosimians
Tarsier                         LTEPKDGRKVSCHPTAWDLGNSDFRILMCTKVTMDYFLTAHHEMGHIQYDMAYATQPFLL
Galago                          LVEPEDGRRVVCHPTAWDLGKDDFRIKMCTKVTMDDFLTAHHEMGHIQYDMAYAKQPFLL
gray_mouse_lemur                LTEPEDGRKVICHPTAWDLGKGDFRIKMCTKVTMDNFLTAHHEMGHIQYDMAYAIQPFLL
Coquerel's_sifaka               LTEPEDGRKVICHPTAWDLGKGDFRIKMCTKVTMDDFLTAHHEMGHIQYDMAYAIQPFLL
```

Apes

```
                  390s        400s        410s        420s        430s        440s
       34567890123456789012345678901234567890123456789012345678901234567890123456789012
Human                          RNGANEGFHEAVGEIMSLSAATPKHLKSIGLLSPDFQEDNETEINFLLKQALTIVGTLPF
Chimpanzee                     RNGANEGFHEAVGEIMSLSAATPKHLKSIGLLSPDFQEDNETEINFLLKQALTIVGTLPF
Bonobo                         RNGANEGFHEAVGEIMSLSAATPKHLKSIGLLSPDFQEDNETEINFLLKQALTIVGTLPF
Gorilla                        RNGANEGFHEAVGEIMSLSAATPKHLKSIGLLSPDFQEDNETEINFLLKQALTIVGTLPF
Northern_white-cheeked_gibbon  RNGANEGFHEAVGEIMSLSAATPKHLKSIGLLSPDFQEDNETEINFLLKQALTIVGTLPF
Sumatran_orangutan             RNGANEGFHEAVGEIMSLSAATPKHLKSIGLLSPDFQEDNETEINFLLKQALTIVGTLPF
```

Old World Monkeys

```
                                 390s        400s        410s        420s        430s        440s
         3456789012345678901234567890123456789012345678901234567890123456789012
Red_colobus_monkey               RSGANEGFHEAVGEIMSLSAATPKHLKSIGLLSPDFQEDNETEINFLLKQALTIVGTLPF
Golden_snub-nosed_monkey         RNGANEGFHEAVGEIMSLSAATPKHLKSIGLLSPDFQEDNETEINFLLKQALTIVGTLPF
Black_snub-nosed_monkey          RNGANEGFHEAVGEIMSLSAATPKHLKSIGLLSPDFQEDNETEINFLLKQALTIVGTLPF
African_green_monkey             RNGANEGFHEAVGEIMSLSAATPKHLKSIGLLSPDFQEDNETEINFLLKQALTIVGTLPF
Sooty_mangabey                   RNGANEGFHEAVGEIMSLSAATPKHLKSIGLLSPDFQEDNETEINFLLKQALTIVGTLPF
Mandrill                         RNGANEGFHEAVGEIMSLSAATPKHLKSIGLLSPDFQEDNETEINFLLKQALTIVGTLPF
Rhesus_macaque                   RNGANEGFHEAVGEIMSLSAATPKHLKSIGLLSPDFQEDNETEINFLLKQALTIVGTLPF
Pig-tailed_macaque_(nemestrina)  RNGANEGFHEAVGEIMSLSAATPKHLKSIGLLSPDFQEDNETEINFLLKQALTIVGTLPF
Crab-eating_macaque_(fascicularis) RNGANEGFHEAVGEIMSLSAATPKHLKSIGLLSPDFQEDNETEINFLLKQALTIVGTLPF
Gelada_baboon                    RNGANEGFHEAVGEIMSLSAATPKHLKSIGLLSPDFQEDNETEINFLLKQALTIVGTLPF
Olive_baboon                     RNGANEGFHEAVGEIMSLSAATPKHLKSIGLLSPDFQEDNETEINFLLKQALTIVGTLPF
```

New World Monkeys

```
                           390s        400s        410s        420s        430s        440s
         34567890123456789012345678901234567890123456789012345678901234567890123456789012
white-tufted-ear_marmoset  RNGANEGFHEAVGEIMSLSAATPKHLKSIGLLSPDFQEDSETEINFLLKQALTIVGTLPF
Bolivian_squirrel_monkey   RNGANEGFHEAVGEIMSLSAATPKHLKSIGLLSPDFQEDSETEINFLLKQALTIVGTLPF
Ma's_night_monkey          RNGANEGFHEAVGEIMSLSAATPKHLKSIGLLSPDFQEDSETEINFLLKQALTIVGTLPF
White-faced_capuchin       RNGANEGFHEAVGEIMSLSAATPKHLKSIGLLSPDFQEDSETEINFLLKQALTIVGTLPF
Tufted_capuchin            RNGANEGFHEAVGEIMSLSAATPKHLKSIGLLSPDFQEDSETEINFLLKQALTIVGTLPF
```

Prosimians

```
                   390s        400s        410s        420s        430s        440s
         34567890123456789012345678901234567890123456789012345678901234567890123456789012
Tarsier            RNGANEGFHEAVGEIMSLSAATPKHLKSIGLLPDFQEDNETEINFLLKQALTIVGTLPF
Galago             RSGANEGFHEAVGEIMSLSVATPKHLQSIGILPDFQEDNETEINFLLKQALTIVGTLPF
gray_mouse_lemur   RNGANEGFHEAVGEIMSLSAATPKHLKSIGILPRDFQEDDETEINFLLKQALTIVGTLPF
Coquerel's_sifaka  RDGANEGFHEAVGEIMSLSAATPKHLKSIGLLPPDFEEDNETEINFLLKQALTIVGTLPF
```

```
                              450s      460s      470s      480s      490s      500s
                   3456789012345678901234567890123456789012345678901234567890123456789012
Apes
Human              TYMLEKWRWMVFKGEIPKDQWMKKWWEMKREIVGVVEPVPHDETYCDPASLFHVSNDYSF
Chimpanzee         TYMLEKWRWMVFKGEIPEDQWMKKWWEMKREIVGVVEPVPHDETYCDPASLFHVSNDYSF
Bonobo             TYMLEKWRWMVFKGEIPKDQWMKKWWEMKREIVGVVEPVPHDETYCDPASLFHVSNDYSF
Gorilla            TYMLEKWRWMVFKGEIPKDQWMKKWWEMKREIVGVVEPVPHDETYCDPASLFHVSNDYSF
Northern_white-cheeked_gibbon  TYMLEKWRWMVFKGEIPKDQWMKKWWEMKREIVGVVEPVPHDETYCDPASLFHVSNDYSF
Sumatran_orangutan TYMLEKWRWMVFKGEIPKDQWMKKWWEMKREIVGVVEPVPHDETYCDPASLFHVSNDYSF 450s      460s      470s      480s      490s      500s
                   3456789012345678901234567890123456789012345678901234567890123456789012
Old World Monkeys
Red_colobus_monkey TYMLEKWRWMVFKGEIPKDQWMKKWWEMKREIVGVVEPVPHDETYCDPASLFHVSNDYSF
Golden_snub-nosed_monkey TYMLEKWRWMVFKGEIPKDQWMKKWWEMKREIVGVVEPVPHDETYCDPASLFHVSNDYSF
Black_snub-nosed_monkey TYMLEKWRWMVFKGEIPKDQWMKKWWEMKREIVGVVEPVPHDETYCDPASLFHVSNDYSF
African_green_monkey TYMLEKWRWMVFKGEIPKDQWMKKWWEMKREIVGVVEPVPHDETYCDPASLFHVSNDYSF
Sooty_mangabey     TYMLEKWRWMVFKGEIPKDQWMKKWWEMKREIVGVVEPVPHDETYCDPASLFHVSNDYSF
Mandrill           TYMLEKWRWMVFKGEIPKDQWMKKWWEMKREIVGVVEPVPHDETYCDPASLFHVSNDYSF
Rhesus_macaque     TYMLEKWRWMVFKGEIPKDQWMKKWWEMKREIVGVVEPVPHDETYCDPASLFHVSNDYSF
Pig-tailed_macaque_(nemestrina) TYMLEKWRWMVFKGEIPKDQWMKKWWEMKREIVGVVEPVPHDETYCDPASLFHVSNDYSF
Crab-eating_macaque_(fascicularis) TYMLEKWRWMVFKGEIPKDQWMKKWWEMKREIVGVVEPVPHDETYCDPASLFHVSNDYSF
Gelada_baboon      TYMLEKWRWMVFKGEIPKDQWMKKWWEMKREIVGVVEPVPHDETYCDPASLFHVSNDYSF
Olive_baboon       TYMLEKWRWMVFKGEIPKDQWMKKWWEMKREIVGVVEPVPHDETYCDPASLFHVSNDYSF 450s      460s      470s      480s      490s      500s
                   3456789012345678901234567890123456789012345678901234567890123456789012
New World Monkeys
white-tufted-ear_marmoset TYMLEKWRWMVFKGEIPKEQWMKKWWEMKREIVGVVEPVPHDETYCDPASLFHVSNDYSF
Bolivian_squirrel_monkey TYMLEKWRWMVFMGEIPKEQWMKKWWEMKREIVGVVEPVPHDETYCDPASLFHVSNDYSF
Ma's_night_monkey  TYMLEKWRWMVFKGEIPKEQWMKKWWEMKREIVGVVEPVPHDETYCDPASLFHVSNDYSF
White-faced_capuchin TYMLEKWRWMVFKGEIPKEQWMKKWWEMKREIVGVVEPVPHDETYCDPASLFHVSNDYSF
Tufted_capuchin    TYMLEKWRWMVFKGEIPKEQWMKKWWDMKREIVGVVEPVPHDETYCDPASLFHVSNDYSF 450s      460s      470s      480s      490s      500s
                   3456789012345678901234567890123456789012345678901234567890123456789012
Prosimians
Tarsier            TYMLEKWRWMVFKGEIPKEQWMQKWWEMKREIVGVVEPLPHDETYCDPASLFHVSNDYSF
Galago             TYMLEKWRWMVFKGEIPKDQWMKKWWEMKREIVGVVEPLPHDETYCDPASLFHVSNDYSF
gray_mouse_lemur   TYMLEKWRWMVFKGEIPKDQWMKKWWEMKREIVGVVEPVPHDETYCDPASLFHVSNDYSF
Coquerel's_sifaka  TYMLEKWRWMVFKGEIPKDQWMKKWWEMKREIVGVVEPLPHDETYCDPASLFHVSNDYSF
```

Apes

```
Human                            IRYYTRTLYQFQFQEALCQAAKHEGPLHKCDISNSTEAGQKLFNMLRLGKSEPWTLALEN
Chimpanzee                       IRYYTRTLYQFQFQEALCQAAKHEGPLHKCDISNSTEAGQKLFNMLRLGKSEPWTLALEN
Bonobo                           IRYYTRTLYQFQFQEALCQAAKHEGPLHKCDISNSTEAGQKLFNMLRLGKSEPWTLALEN
Gorilla                          IRYYTRTLYQFQFQEALCQAAKHEGPLHKCDISNSTEAGQKLFNMLRLGKSEPWTLALEN
Northern_white-cheeked_gibbon    IRYYTRTLYQFQFQEALCQAAKHEGPLHKCDISNSTEAGQKLLNMLRLGKSEPWTLALEN
Sumatran_orangutan               IRYYTRTLYQFQFQEALCQAAKHEGPLHKCDISNSTEAGQKLLNMLRLGKSEPWTLALEN
```

```
                    510s      520s      530s      540s      550s      560s
             345678901234567890123456789012345678901234567890123456789012
```

Old World Monkeys

```
Red_colobus_monkey               IRYYTRTLYQFQFQEALCQAAKHEGPLHKCDISNSTEAGQKLLNMLKLGKSEPWTLALEN
Golden_snub-nosed_monkey         IRYYTRTLYQFQFHEALCQAAKHEGPLHKCDISNSTEAGQKLLNMLKLGKSEPWTLALEN
Black_snub-nosed_monkey          IRYYTRTLYQFQFHEALCQAAKHEGPLHKCDISNSTEAGQKLLNMLKLGKSEPWTLALEN
African_green_monkey             IRYYTRTLYQFQFQEALCQAAKHEGPLHKCDISNSTEAGQKLLNMLKLGKSEPWTLALEN
Sooty_mangabey                   IRYYTRTLYQFQFQEALCQAAKHEGPLHKCDISNSTEAGQKLLNMLKLGKSEPWTLALEN
Mandrill                         IRYYTRTLYQFQFQEALCQAAKHEGPLHKCDISNSTEAGQKLLNMLKLGKSEPWTLALEN
Rhesus_macaque                   IRYYTRTLYQFQFQEALCQAAKHEGPLHTCDISNSTEAGQKLLNMLKLGESEPWTLALEN
Pig-tailed_macaque (nemestrina)  IRYYTRTLYQFQFQEALCQAAKHEGPLHKCDISNSTEAGQKLLNMLKLGKSEPWTLALEN
Crab-eating_macaque (fascicularis) IRYYTRTLYQFQFQEALCQAAKHEGPLHKCDISNSTEAGQKLLNMLKLGKSEPWTLALEN
Gelada_baboon                    IRYYTRTLYQFQFQEALCQAAKHEGPLHKCDISNSTEAGQKLLNMLKLGKSEPWTLALEN
Olive_baboon                     IRYYTRTLYQFQFQEALCQAAKHEGPLHKCDISNSTEAGQKLLNMLKLGKSEPWTLALEN
```

```
                    510s      520s      530s      540s      550s      560s
             345678901234567890123456789012345678901234567890123456789012
```

New World Monkeys

```
white-tufted-ear_marmoset        IRYYTRTLYQFQFQEALCQAAKHEGPLHKCDISSSTEAGQKLLNMLRLGKSEPWTLALEN
Bolivian_squirrel_monkey         IRYYTRTLYQFQFQEALCQAAKHEGPLHKCDISSSTEAGQKLLNMLRLGKSEPWTLALEN
Ma's_night_monkey                IRYYTRTLYQFQFQEALCQAAKHEGPLHKCDISSSTEAGQKLLNMLRLGKSEPWTLALEN
White-faced_capuchin             IRXYTRTLYQFQFQEALCQAAKHEGPLHKCDISSSTEAGQKLLNMLRLGKSEPWTLALEN
Tufted_capuchin                  IRXYTRTLYQFQFQEALCQAAKHEGPLHKCDISSSTEAGQKLLNMLRLGKSEPWTLALEN
```

```
                    510s      520s      530s      540s      550s      560s
             345678901234567890123456789012345678901234567890123456789012
```

Prosimians

```
Tarsier                          IRYYTRTIYQFQFQEALCQAAKHEGPLHKCDISNSVEAGQKLFQMLRLGKSEPWTLALKN
Galago                           IRYYTRTIYQFQFQEALCQAAQHQGPLHKCDISRSTEAGQKLLNMMSLGKSEPWTLALEN
gray_mouse_lemur                 IRYYTRTIYQFQFQEALCRAAKHEGPLHRCDISNSTEAGQKLLNMLRLGKSEPWTLALEN
Coquerel's_sifaka                IRYYTRTIYQFQFQEALCQVAKHEGPLHRCDISNSTEAGQKLLNMLSLGKSEPWTLALEN
```

```
                570s      580s      590s      600s      610s      620s
                3456789012345678901234567890123456789012345678901234567890123456789012
Apes
Human                      VVGAKNMNVRPLLNYFEPLFTWLKDQNKNSFVGWSTDWSPYADQSIKVRISLKSALGDKA
Chimpanzee                 VVGAKNMNVRPLLNYFEPLFTWLKDQNKNSFVGWSTDWSPYADQSIKVRISLKSALGDKA
Bonobo                     VVGAKNMNVRPLLNYFEPLFTWLKDQNKNSFVGWSTDWSPYADQSIKVRISLKSALGDKA
Gorilla                    VVGAKNMNVRPLLNYFEPLFTWLKDQNKNSFVGWSTDWSPYADQSIKVRISLKSALGDKA
Northern_white-cheeked_gibbon  VVGAKNMNVRPLLNYFEPLFTWLKDQNKNSFVGWSTDWSPYADQSIKVRISLKSALGDEA
Sumatran_orangutan         VVGAKNMNVRPLLNYFEPLFTWLKDQNKNSFVGWSTDWSPYADQSIKVRISLKSALGNKA 570s      580s      590s      600s      610s      620s
                3456789012345678901234567890123456789012345678901234567890123456789012
Old World Monkeys
Red_colobus_monkey         VVGAKNMNVRPLLNYFEPLFTWLKDQNKNSFVGWSTDWSPYADQSIKVRISLKSALGDKA
Golden_snub-nosed_monkey   VVGAKNMNVRPLLNYFEPLFTWLKDQNKNSFVGWSTDWSPYADQSIKVRISLKSALGDKA
Black_snub-nosed_monkey    VVGAKNMNVRPLLNYFEPLFTWLKDQNKNSFVGWSTDWSPYADQSIKVRISLKSALGDKA
African_green_monkey       VVGAKNMNVRPLLNYFEPLFTWLKDQNKNSFVGWSTDWSPYADQSIKVRISLKSALGANA
Sooty_mangabey             VVGAKNMNVRPLLNYFEPLFTWLKDQNKNSFVGWSTDWSPYADQSIKVRISLKSALGDKA
Mandrill                   VVGAKNMNVRPLLNYFEPLFTWLKDQNKNSFVGWSTDWSPYADQSIKVRISLKSALGDKA
Rhesus_macaque             VVGAKNMNVRPLLNYFEPLFTWLKDQNKNSFVGWSTDWSPYADQSIKVRISLKSALGDKA
Pig-tailed_macaque (nemestrina)    VVGAKNMNVRPLLNYFEPLFTWLKDQNKNSFVGWSTDWSPYADQSIKVRISLKSALGDKA
Crab-eating_macaque (fascicularis) VVGAKNMNVRPLLNYFEPLFTWLKDQNKNSFVGWSTDWSPYADQSIKVRISLKSALGDKA
Gelada_baboon              VVGAKNMNVRPLLNYFEPLFTWLKDQNKNSFVGWSTDWSPYADQSIKVRISLKSALGDKA
Olive_baboon               VVGAKNMNVRPLLNYFEPLFTWLKDQNKNSFVGWSTDWSPYADQSIKVRISLKSALGDKA 570s      580s      590s      600s      610s      620s
                3456789012345678901234567890123456789012345678901234567890123456789012
New World Monkeys
white-tufted-ear_marmoset  VVGAKNMDVRPLLNYFEPLFTWLKDQNKNSFVGWSTNWSPYTDQSIKVRISLKSALGDQA
Bolivian_squirrel_monkey   VVGAKNMDVRPLLNYFEPLFTWLKDQNKNSFVGWSTNWSPYTDQRIKVRISLKSALGDQA
Ma's_night_monkey          VVGAKNMDVRPLLNYFEPLFTWLKDQNKNSFVGWITNWSPYTDQRIKVRISLKSALGDQA
White-faced_capuchin       VVGAKNMDVRPLLNYFEPLFTWLKDQNKNSFVGWSTSWSPYTDQSIKVRISLKSALGDQA
Tufted_capuchin            VVGAKNMDVRPLLNYFEPLFTWLKDQNKNSFVGWSTNWSPYTDQRIKVRISLKSALGDQA 570s      580s      590s      600s      610s      620s
                3456789012345678901234567890123456789012345678901234567890123456789012
Prosimians
Tarsier                    IVGEKNMNVRPLLSYFEPLLTWLKDQNKNSFVGWTTDWSPYADESIKVRISLKSALGENA
Galago                     VVGARNMDVSPLLTYFEPLFTWLKEQNRNSFVGWDTNWSPYADQSIKVRISLKSGLGDKP
gray_mouse_lemur           VVGARNMNVTPLLNYFEPLFTWLKDQNRNSFVGWNTNWSPYADESIKVRISLKSALGTNA
Coquerel's_sifaka          VVGARNMDVTPLLNYFEPLFTWLKDQNRNSFVGWNTNWSPYADQSIKVRISLKSALGDKA
```

```
                  630s        640s       650s       660s
                        567890123456789012345678901234567890012
Apes
Human                34 YE------WNDNEMYLFRSSVAYAMRQYFLKVKNQMILFGEEDVRV
Chimpanzee              YE------WNDNEMYLFRSSVAYAMRQYFLKVKNQMILFGEEDVRV
Bonobo                  YE------WNDNEMYLFRSSVAYAMRQYFLKVKNQMILFGEEDVRV
Gorilla                 YE------WNDNEMYLFRSSVAYAMRQYFLEVKKQMILFGEEDVRV
Northern_white-cheeked_gibbon YE------WNDNEMYLFRSSVAYALRKYFLKVKNQMILFGEEDVRV
Sumatran_orangutan      YE------WNDNEMYLFRSSVAYAMRKYFLEVKNQMILFGEEDVRV 630s        640s       650s       660s
                        567890123456789012345678901234567890012
Old World Monkeys
Red_colobus_monkey   34 YE------WNDNEMYLFRSSVAYAMRKYFLEIKHQTILFGEEDVRV
Golden_snub-nosed_monkey YE------WNDNEMYLFRSSVAYAMRKYFLEIKHQTILFGEEDVRV
Black_snub-nosed_monkey  YE------WNDNEMYLFRSSVAYAMRKYFLEIKHQTILFGEEDVRV
African_green_monkey    YK------WNDNEMYLFRSSVAYAMRQYFLENKHQTILFGEEDVRV
Sooty_mangabey          YE------WNDNEMYLFRSSVAYAMRKYFLERKHQTILFGEEDVRV
Mandrill                YE------WNDNEMYLFRSSVAYAMRKYFLERKHQTILFGEEDVRV
Rhesus_macaque          YE------WNDNEMYLFRSSVAYAMRTYFLEIKHQTILFGEEDVRV
Pig-tailed_macaque (nemestrina) YE------WNDNEMYLFRSSVAYAMRTYFLEIKHQTILFGEEDVRV
Crab-eating_macaque (fascicularis) YE------WNDNEMYLFRSSVAYAMRKYFLEIKHQTILFGEEDVRV
Gelada_baboon           YE------WNDNEMYLFRSSVAYAMRTYFLEIKHQTILFGEEDVRV
Olive_baboon            YE------WNDNEMYLFRSSVAYAMRTYFLEIKHQTILFGEEDVRV 630s        640s       650s       660s
                        567890123456789012345678901234567890012
New World Monkeys
white-tufted-ear_marmoset 34 YK------WNDNEMYLFRSSVAYAMREYFLKVKNQMIPFGEEDVRV
Bolivian_squirrel_monkey  YE------WNDNEMYLFRSSVAYAMRKYFLKVKNQTIPFGEEDVRV
Ma's_night_monkey         YE------WNDNEMYLFRSSIAYAMREYFFKVKNQTIPFGEEDVRV
White-faced_capuchin      YE------WNDNEMYLFRSSVAYAMREYFLKAKNQMIPFGEEDVRV
Tufted_capuchin           YE------WNDNEMYLFRSSVAYAMREYFLKAKNQMIPFGEEDVRV 630s        640s       650s       660s
                        567890123456789012345678901234567890012
Prosimians
Tarsier              34 YT------WNDNEMYFFQSSVAYAMRKYFLVVKNQMMPFGVENVWI
Galago                  YE------WNDNEMYLFQSSVAYAMRQYFSECKQQTVPFGEEDVWV
gray_mouse_lemur        VSVFESLFFQLTIFFTCRPNKHNGMTKELYLFPVICGICMRKVFLEAKSQTVPFGVEDVWV
Coquerel's_sifaka       YE------WNDNEMFLFRSSVAYAMREYFLKVKNQTVLFGVEDVWV
```

Apes
```
Human                           ANLKPRISFNFFVTAPKNVSDIIPRTEVEKAIRMSRSRINDAFRLNDNSLEFLGIQPTLG
Chimpanzee                      ANLKPRISFNFFVTAPKNVSDIIPRTEVEKAIRKSRSRINDAFRLNDNSLEFLGIQPTLG
Bonobo                          ANLKPRISFNFFVTAPKNVSDIIPRTEVEKAIRKSRSRINDAFRLNDNSLEFLGIQPTLG
Gorilla                         ANLKPRISFNFFVTAPKNVSDIIPRTEVEKAIRMSRGRINDAFRLNDNSLEFLGIQPTLG
Northern_white-cheeked_gibbon   ANLKPRISFNFFVTAPKNVSDIIPRTEVEKAIRMSRSRINDAFRLNDNSLEFLGIQPTLG
Sumatran_orangutan              ANLKPRISFNFFVTAPKNVSDIIPRTEVEKAIRMSRSRINDAFRLNDNSLEFLGIQPTLG
```

```
                670s       680s       690s       700s       710s       720s
          3456789012345678901234567890123456789012345678901234567890123456789012
```

Old World Monkeys
```
Red_colobus_monkey              ADLKPRISFNFYVTAPKNVSDIIPRTEVEEAIRLSRSRINDAFRLNDDSLEFLGIQPTLA
Golden_snub-nosed_monkey        ADFKPRISFNFYVTAPKNVSDIIPRTEVEEAIRISRSRINDAFRLNDNSLEFLGIQPTLA
Black_snub-nosed_monkey         ADLKPRISFNFYVTAPKNVSDIIPRTEVEEAIRISRSRINDAFRLNDNSLEFLGIQPTLA
African_green_monkey            ADLKPRISFNFYVTAPKNVSDIIPRTEVEEAIRFSRSRINDAFQLNDNSLEFLGIQSTLI
Sooty_mangabey                  ADLKPRISFNFYVTAPKNVSDIIPRTEVEEAIRNSRSRINDAFRLNDNSLEFLGIQTTLA
Mandrill                        ADLKPRISFNFYVTAPKNVSDIIPRTEVEEAIRMSRSRINDAFRLNDNSLEFLGIPTTLA
Rhesus_macaque                  ADLKPRISFNFYVTAPKNVSDIIPRTEVEEAIRISRSRINDAFRLNDNSLEFLGIQTTLA
Pig-tailed_macaque (nemestrina) ADLKPRISFNFYVTAPKNVSDIIPRTEVEEAIRISRSRINDAFRLNDNSLEFLGIQTTLA
Crab-eating_macaque (fascicularis) ADLKPRISFNFYVTAPKNVSDIIPRTEVEEAIRISRSRINDAFRLNDNSLEFLGIEPTLA
Gelada_baboon                   ADLKPRISFNFYVTAPKNVSDIIPRTEVEEAIRISRSRINDAFRLNDNSLEFLGIEPTLA
Olive_baboon                    ADLKPRISFNFYVTAPKNVSDIIPRTEVEEAIRISRSRINDAFRLNDNSLEFLGIEPTLA
```

```
                670s       680s       690s       700s       710s       720s
          3456789012345678901234567890123456789012345678901234567890123456789012
```

New World Monkeys
```
white-tufted-ear_marmoset       ADLKPRISFNFFVTAPQNVSDIIPRIEVEKAISMSRSRINDAFGLNDNSLEFLGIQPTLE
Bolivian_squirrel_monkey        ADLKPRISFNFFVTAPQNVSDIIPRIEVEEAIRMSRSRINDAFHLNDNSLEFLGIQPTLG
Ma's_night_monkey               ADLKPRISFNFFVTAPQNVSDIIPRIEVEEAIRMSRSRINDAFRLNDNSLEFLGIQPTLG
White-faced_capuchin            ADLKPRISFNFFVTAPQNVSDIIPRIEVEEAIRMSRSRINDAFRLNDNSLEFLGIQPTLG
Tufted_capuchin                 ADLKPRISFNFFVTAPQNVSDIIPRIEVEEAIRMSRSRINDAFRLNDNSLEFLGIQPTLG
```

```
                670s       680s       690s       700s       710s       720s
          3456789012345678901234567890123456789012345678901234567890123456789012
```

Prosimians
```
Tarsier                         SDLKPRVSFNFFVTSPKNLNDIIPRTEVEEAIRMSRGRINNAFHLDDNTLEFLGIQPTLA
Galago                          SDIKPRISFSFFVTAPKNVSEIIPRTEVEEAIRMSRSRINGVFRLDDNSLEFLGIQPTLS
gray_mouse_lemur                NDFKPRISFTFFVTAPKNVSDIIPRTEVEKAISMSRSRINDVFGLDDNTLEFLGIQPTLS
Coquerel's_sifaka               NDLKPRISFTFFVTAPNNVSDIIPRAEVEEAIRKSRSRINDAFGLDDNTLEFLGIQPTLS
```

Apes

```
                     730s      740s      750s      760s      770s      780s
          34567890123456789012345678901234567890123456789012345678901234567890 12
Human                         PPNQPPVSIWLIVFGVVMGVIVVGIVILIFTGIRDRKKKNKARSGENPYASIDISKGENN
Chimpanzee                    PPNQPPVSIWLIVFGVVMGVIVVGIVILIFTGIRDRKKKNKARSEENPYASVDTSKGENN
Bonobo                        PPNQPPVSIWLIVFGVVMGVIVVGIVILIFTGIRDRKKKNKARSEENPYASVDTSKGENN
Gorilla                       PPNQPPVSIWLIVFGVVMGVIVVGIVILIFTGIRDRKKKNKARSEENPYASIDISKGENN
Northern_white-cheeked_gibbon PPNQPPVTVTIWLIIVFGVVTGVIVVGIVILIFTGIRDRKKKNKARSEENPYASVDISKGENN
Sumatran_orangutan            PPNQPPVSIWLIVFGVVMGVIVVGIVILIFTGIRDRKKKNKARNEENPYASIDISKGENN
```

Old World Monkeys

```
                     730s      740s      750s      760s      770s      780s
          34567890123456789012345678901234567890123456789012345678901234567890 12
Red_colobus_monkey              PPYQPPVTIWLIVFGVVMGVIVAGTVVLIFTGIRDRKKKNQARSEENPYASIDISKGENN
Golden_snub-nosed_monkey        PPYQPPVTIWLIVFGVVMGVIVAGIVVLIFTGIRDRKKKNQARSEENPYASIDISQGENN
Black_snub-nosed_monkey         PPYQPPVTIWLIVFGVVMGVIVAGIVVLIFTGIRDRKKKNQARSEENPYASIDISQGENN
African_green_monkey            PPYQSPVTTWLIVFGVVMGVMAVIVAGIVVLIFTGIRDRKKKNQARSEENPYASIDISKGENN
Sooty_mangabey                  PPYQSPVTTWLIVFGVVMGVIVAGIVVLIFTGIRDRKKKNQARSEENPYASIDISKGENN
Mandrill                        PPYQSPVTTWLIVFGVVMGVIVAGIVVLIFTGIRDRKKKNQARSEENPYASIDISEGENN
Rhesus_macaque                  PPYQSPVTTWLIVFGVVMGVIVAGIVVLIFTGIRDRKKKNQARSEENPYASIDISEGENN
Pig-tailed_macaque (nemestrina) PPYQSPVTTWLIVFGVVMGVIVAGIVVLIFTGIRDRKKKNQARSEENPYASIDINKGENN
Crab-eating_macaque (fascicularis) PPYQSPVTTWLIVFGVVMGVIVAGIVVLIFTGIRDRKKKNQARSEENPYASIDINKGENN
Gelada_baboon                   PPYQSPVTTWLIVFGVVMGVIVAGIVVLIFTGIRDRKKKNQARSEENPYASIDISKGENN
Olive_baboon                    PPYQSPVTTWLIVFGVVMGVIVAGIVVLIFTGIRDRKKKNQARSEENPYASIDISKGENN
```

New World Monkeys

```
                     730s      740s      750s      760s      770s      780s
          34567890123456789012345678901234567890123456789012345678901234567890 12
white-tufted-ear_marmoset     PPYQPPITIWLIVFGVVMGMVVVGIVILIITGIRDRKKKNEARSEENPYASIDFGKGEDN
Bolivian_squirrel_monkey      PPYQPPVTIWLIVFGVVMGMVAVGIVILIITGIRDRKKKNEARSEENPYASIDIGKGEDN
Ma's_night_monkey             PPYQSPVTIWLIVFGVVMGMVVVGIVILIITGIRDRKKKNEARSEENPYADIDIDKGEDN
White-faced_capuchin          PPYQPPVTIWLIVFGVVMGMVVVGIVILIITGIRDRKKKNEARSEENPYASIDIGKGEDN
Tufted_capuchin               PPYQPPVTIWLIVFGVVMGMVVVGIVILIITGIRDRKKKNEARSEENPYASIDIGKGEDN
```

Prosimians

```
                     730s      740s      750s      760s      770s      780s
          34567890123456789012345678901234567890123456789012345678901234567890 12
Tarsier               PPSQPPITIWLIVFGVVMGVVVVGIFVLIFTGIRDRKKKNQARSEENPYASVDSGKGENN
Galago                PPYQPPITIWLIVFGIVMALVVVGIVILIITGIRDRKKKNQARGEENPYAFVDLGKEENT
gray_mouse_lemur      PPYESPISIWLIAFGIVMGLVVVATVVLIFTGIRNRKKKSEERSEENPYASMDINRGEHN
Coquerel's_sifaka     APYQSSVATWLIAFGVVMGLVVVATVVLIFTGIRNRKKKNQERSEENPYAFVDVNRGEHN
```

```
                                        790s    800s
                                        3456789012345
Apes
Northern_white-cheeked_gibbon           PGFENTDDVQTSF
Sumatran_orangutan                      PGFQNTDDVQTSF
Chimpanzee                              PGFQNTDDVQTSF
Bonobo                                  PGFQNTDDVQTSF
Gorilla                                 PGFQNTDDVQTSF
Human                                   PGFQNTDDVQTSF 790s    800s
                                        3456789012345
Old World Monkeys
Red_colobus_monkey                      PGFQNTDDVQTSF
Golden_snub-nosed_monkey                PGFQNTDDVQTSF
Black_snub-nosed_monkey                 PGFQNTDDVQTSF
African_green_monkey                    PGFQNTDDVQTSF
Sooty_mangabey                          PGFQNTDDVQTSF
Mandrill                                PGFQNTDDVQTSF
Rhesus_macaque                          PGFQNTDDVQTSF
Pig-tailed_macaque (nemestrina)         PGFQNTDDVQTSF
Crab-eating_macaque (fascicularis)      PGFQNTDDVQTSF
Gelada_baboon                           PGFQNTDDVQTSF
Olive_baboon                            PGFQNTDDVQTSF 790s    800s
                                        3456789012345
New World Monkeys
white-tufted-ear_marmoset               PGFQNSEEVQTSF
Bolivian_squirrel_monkey                PGFQNSDEVQTSF
Ma's_night_monkey                       PGFENSDEVQTSF
White-faced_capuchin                    PGFQNSDEVQTSF
Tufted_capuchin                         PGFQNSDEVQTSF 790s    800s
                                        3456789012345
Prosimians
Tarsier                                 PGFQSSDDGQTSF
Galago                                  AESPNGDDIQTSF
gray_mouse_lemur                        PGFQNSDDTQTSF
Coquerel's_sifaka                       PGFQNSDDIQTSF
```

```
                          1s        10s       20s       30s       40s       50s
                  1234 5678901234567890123456789012345678901234567890123456789012345678
Mammals
Human             MSSS ---SWLLLSLIVAVTAAQSTIEEQAKTFLDKFNHEAEDLFYQSSLASWNYNTNITEEN
Wombat            MSGSEKSKMTLSLIVAVTAAQFSTEERAKEFLETFNKEAEEISYQSSLASWDYNTNINDEN
Common_vampire_bat MSGS ---SWLFLSLIVAVAAAQTPTEEEARTFLENFNTEAEEWFYQNSLASWNYNTNITDEN
Mus_musculus      MSSS ---SWLLLSLIVAVTTAQSLTEENAKTFLNNFNQEAEDLSYQSSLASWNYNTNITEEN
Norway_rat        MSSS ---CWLLLSLIVAVATAQSLIEEKAESFLNKFNQEAEDLSYQSSLASWNYNTNITEEN
Big_brown_bat     MSGS ---SWLFLSLIVAVTAAQSTTEKNATIFLENFNSEAEDLSHESALASWNYNTNITDEN
Little_brown_bat  MSGS ---SWLFLSLIVAVAAAQSSTEEKAKIFLENFNSKAEDLSHESALASWNYNTNITDEN
Black_flying_fox  MSGS ---FWLLLSLIVAVTAAQSTPEELAKTFLEKFNTEVEDLFYQSSLASWDYNTNITDEN
Large_flying_fox  MSGS ---FWLLLSLIVAVTAAQSTPEELAKTFLEKFNTEVEDLFYQSSLASWDYNTNITDEN
Rabbit            MSGS ---SWLLLSLIVAVTAAQSTIEELAKTFLEKFNQEAEDLSYQSALASWDYNTNITEEN
Pig               MSGS ---FWLLLSLIPVTAAQSTTEELAKTFLEKFNLEAEDLAYQSSLASWTINTNITDEN
Cow               MTGS ---FWLLLSLIVAVTAAQSTTEEQAKTFLEKFNHEAEDLSYQSSLASWNYNTNITDEN
Sheep             MTGS ---FWLLLSLIVAVTAAQSTTEGQAKTFLEKFNHEAEDLSYQSSLASWNYNTNITDEN
Yak               MTGS ---FWLLLSLIVAVTAAQSTTEEQAKTFLEKFNHEAEDLSYQSSLASWNYNTNITDEN
Sperm_whale       MSGS ---FWLLLSLIVAVTAAQSTTEEQAKTFLQKFDHEAEDLSYQSSLASWNYNTNITDEN
Narwhal           MSGS ---FWLLLSLIVAVTAAPSTTEEQAKTFLQKFDHEAEDLSYQSSLASWNYNTNITDEN
Orca              MSGS ---FWLLLSLIVAVTAAQSATEERAKTFLQKFDREAEDLSYQSSLASWNYNTNITDEN
Dog               MSGS ---SWLLLSLAALTAAQST-EDLVKTFLEKFNYEAEELSYQSSLASWNYNINITDEN
Ferret            MLGS ---SWLLLSLAALTAAQSTTEDLAKTFLEKFNYEAEELSYQNSLASWNYNTNITDEN
Panda             MLGS ---SWLLLSLAALTAAQSTTEDLAETFLEKFNYEAEDLYYQSSLASWNYNTNITDEN
California_sea_lion MLGS ---SWLLLSLAALTAARSTTEDLVKTFLEKFNSEAEELSYQSSLASWNYNTNITDEN
Monk_seal         MLGS ---SWLLLSLAALTAAQSTTEDLVKTFLEKFNYEAEELSYQSSLASWNYNTNITDEN
Meerkat           MSGS ---FWLLLSFAALTAAQSTTEELAKTFLEQFNHEAQELSYLSSVASWNYNTNITDEN
Masked_palm_civet MSGS ---FWLLLSFAALTAAQSTTEELAKTFLETFNYEAQELSYQSSVASWNYNTNITDEN
Puma              MSGS ---FWLLLSFAALTAAQSTTEELAKTFLEKFNHEAEELSYQSSLASWNYNTNITDEN
Cat               MSGS ---FWLLLSFAALTAAQSTTEELAKTFLEKFNHEAEELSYQSSLASWNYNTNITDEN
Lynx              MSGS ---FWLLLSFAALAAAQSTTEELAKTFLEKFNHEAEELSYQSSLASWNYNTNITDEN
Pangolin          MSGS ---SWLLLSLIVAVTAAQSTSDEEAKTFLEKFNSEAEELSYQSSLASWNYNTNITDEN
Horse             MSGS ---SWLLLSLIVAVTAAQSTTEDLAKTFLEKFNSEAEELSHQSSLASWSYNTNITDEN
```

```
                    60s        70s        80s        90s       100s       110s
                    901234567890123456789012345678901234567890123456789012345678
Mammals
Human               VQNMNNAGDKWSAFLKEQSTLAQMYPLQEIQNLTVKLQLQALQQNGSSVLSEDKSKRLNT
Wombat              VQKMNEAAARWSAFYKSQSNISRTFPLNEISDPQIKLQLKSLQEKGAAVLSAEKSARLNT
Common_vampire_bat  VQKMNEAEQMWSTFYERNSNIAKTYPLETIKDVNVKRQLQALQQNGL-LEDKDKQLQLNA
Mus_musculus        AQKMSEAAAKWSAFYEEQSKTAQSFSLQEIQTPIIKRQLQALQQSGSSALSADKNKQLNT
Norway_rat          AQKMNEAAAKWSAFYEEQSKIAQNFSLQEIQNATIKRQLKALQQSGSSALSPDKNKQLNT
Big_brown_bat       AQKMNEADSKWSAFYEKQSKLLAQTYPLQEIQNLTIKLQLQVLQQNGSSVLTADKSKRLST
Little_brown_bat    VQKMNEADSKWSAFYEQQSKLAQTYPLQEIQNSTIKRQLQVLQQNGSSVLSADKSKRLNT
Black_flying_fox    VQKMNEARAKWSAFYEEQSKLLAKAYQLDEIQDPILKLQLRILQQSGSSVLSADKTKRLNT
Large_flying_fox    VQKMNEARAKWSAFYEEQSKLLAKAYQLDEIQDPILKLQLRILQQSGSSVLSADKTKRLNT
Rabbit              VQKMNDAEAKWSAFYEEQSKLLAKTYPSQEVQNLTVKRQLQALQQSGSSALSADKSKQLNT
Pig                 IQKMNDARAKWSAFYEEQSRIAKTYPLDEIQTLIIKRQLQALQQSGTSGLSADKSKRLNT
Cow                 VQKMNEARAKWSAFYEEQSRMAKTYSLEEIQNLTLKRQLKALQHSGTSALSAEKSKRLNT
Sheep               VQKMNEARAKWSAFYEEQSRMARTYSLEEIQNLTLKRQLTLKRQLKALQHSGTSVLSAEKSKRLNT
Yak                 VQKMNEARAKWSAFYEEQSRMAKTYSLEEIQNLTLKRQLKALQHSGTSVLSAEKSKRLNT
Sperm_whale         VQKMNAARAKWSAFYEEQSRTAKTYPLEEIQNLTLKRQLQALQQSGTSVLSADKSKRLNT
Narwhal             VQKMNAAGAKWSAFYEEQSKIAKTYPLAEIRNLTLKRQLQVLQQSGTSVLSADKSKRLNT
Orca                VQKMNAAGAKWSAFYEEQSRIAKTYPLEEIRNLTLKRQLQVLQQSGTSVLSADKSKRLNA
Dog                 VQKMNNAGAKWSAFYEEQSKLAKTYPLEEIQDSTVKRQLRALQHSGSSVLSADKNQRLNT
Ferret              IQKMNIAGAKWSAFYEEESQHAKTYPLEEIQDPIIKRQLRALQHSGSSVLSADKRERLNT
Panda               IEKMNDAGAKWSAFYEEQSKHAKTYPLEEIHNSTVKRQLQALQHSGSSVLSADKSQRLNT
California_sea_lion VQKMNDAGAKWSAFYEEQSKQAKTYPLEEIQDSTVKRQLQALQHSGSSVLSADKSQRLNT
Monk_seal           IQKMNVAEAKWSAFYKNQSKQAKTYPLEEIQDSTLKRQLQTLQHSGSSVLSADKSERLST
Meerkat             VKQMNEAGAKWSAFYEEQSKRAKAYPLAEIQNTTVKRQLQALQQSGSSVLSPEKGQRLNT
Masked_palm_civet   AKNMNEAGAKWSAYYEEQSKLLAQTYPLAEIQDAKIKRQLQALQQSGSSVLSADKSQRLNT
Puma                VQKMNEAGAKWSAFYEEQSKLLAKTYPLAEIHNTTVKRQLQALQQSGSSVLSADKSQRLNT
Cat                 VQKMNEAGAKWSAFYEEQSKLLAKTYPLAEIHNTTVKRQLQALQQSGSSVLSADKSQRLNT
Lynx                VQKMNEAGAKWSAFYEEQSKLLAKTYPLAEIHNTTIKRQLQALQQSGSSVLSADKSQRLNT
Pangolin            VQKMNVAGAKWSTFYEEQSKIAKNYQLQNIQNDTIKRQLQALQLSGSSALSADKNQRLNT
Horse               VQKMNEAGARWSAFYEEQSKLLAKTYPLEEIQNLTVKRQLQALQQSGSSVLSADKSKRLNE
```

```
                    120s      130s      140s      150s      160s      170s
                  9012345678901234567890123456789012345678901234567890123456789012345678
Mammals
Human             ILNTMSTIYSTGKVCNPDNPQECLLLEPGLNEIMANSLDYNERLWAWESWRSEVGKQLRP
Wombat            VLNTMSTLYSTATICNPKTTQECILLEPGILDKIMEESKDYYERLWAWEGWRSKVGKEMRP
Common_vampire_bat ILNTMSTIYSTGKVCKPNNPQECYLLATGLEDIMQDSKDYNERLWAWEGWRSKVGKQLRP
Mus_musculus      ILNTMSTIYSTGKVCNPKNPQECILLEPGLDEIMATSTDYNSRLWAWEGWRAEVGKQLRP
Norway_rat        ILNTMSTIYSTGKVCNSMNPQECFLLEPGLDEIMATSTDYNRRLWAWEGWRAEVGKQLRP
Big_brown_bat     ILTTMSTIYSTGKVCNPNNPQECLTL-SGLEDIMEKSKDYNQRLWVWEGWRSEVGKQLRP
Little_brown_bat  ILTTMSTIYSTGKVCNPNNPQECFTL-AGLEEIMEKSKDYNQRLWVWEGWRSEVGKQLRP
Black_flying_fox  ILNTMSIIYSTGKVCKPDNPQECLLLEPGLDDIMESSKDYDQRLWAWEGWRSEVGKQLRP
Large_flying_fox  ILNTMSIIYSTGKVCKPDNPQECILLEPGLDDIMESSKDYDQRLWAWEGWRSEVGKQLRP
Rabbit            ILSTMSTIYSTGKVCNQSNPQECFLLEPGLDEIMAKSTDYNERLWAWEGWRSVVGKQLRP
Pig               ILNTMSTIYSSGKVLDPNNPQECLVLEPGLDDIMENSKDYSRRLWAWESWRAEVGKQLRP
Cow               ILNKMSTIYSTGKVLDP-NTQECLALEPGLDDIMENSRDYNRRLWAWEGWRAEVGKQLRP
Sheep             ILNKMSTIYSTGKVLDP-NTQECLALEPGLDDIMENSRDYNRRLWAWEGWRAEVGKQLRP
Yak               ILNKMSTIYSTGKVLDP-NTQECLALEPGLDDIMENSRDYNRRLWAWEGWRAEVGKQLRP
Sperm_whale       ILNTMSTIYSSGKVLDP-NTQECLVLEPGLDDIMENSEDYSRRLWAWEAWRAEVGKQLRP
Narwhal           ILSTMSTIYSSGKVLDP-NTQECLVLEPGLDDIMENSKDYNRRLWAWEGWRAEVGKQLRP
Orca              ILSTMSTIYSSGKVLDP-NTQECLVLEPGLDDIMENSKDYSRRLWAWEGWRAEVGKQLRP
Dog               ILNSMSTVYSTGKACNPSNPQECLLLEPGLDDIMENSKDYNERLWAWEGWRSEVGKQLRP
Ferret            ILNAMSTIYSTGKACNPNNPQECLLLEPGLDDIMENSKDYNERLWAWEGWRSEVGKQLRP
Panda             ILNAMSTIYSTGKACNPNNPQECLLLEPGLDDIMENSNDYNERLWAWEGWRSEVGKQLRP
California_sea_lion ILNAMSTIYSTGKACNPNNPQECLLLEPGLDDIMANSRDYNERLWAWEGWRSEVGKQLRP
Monk_seal         ILNAMGTIYSTGKACNPNNPQECLLLEPGLDDIMANSRDYNERLWAWEGWRSEVGKQLRP
Meerkat           ILNAMSTIYSTGKACNPNNPQECILFLEPGLDNIMENSRDYNERLWAWEGWRAEVGKQLRP
Masked_palm_civet ILNAMSTIYSTGKACNPNNPQECLLLEPGLDNIMENSKDYNERLWAWEGWRAEVGKQLRP
Puma              ILNAMSTIYSTGKACNPNNPQECLLLEPGLDDIMENSKDYNERLWAWEGWRAEVGKQLRP
Cat               ILNAMSTIYSTGKACNPNNPQECLLLEPGLDDIMENSKDYNERLWAWEGWRAEVGKQLRP
Lynx              ILNAMSTIYSTGKACNPNNPQECLLLEPGLDDIMENSKDYNERLWAWEGWRAEVGKQLRP
Pangolin          ILNTMSTIYSTGKVCNPGNPQECSLLEPGLDNIMESSKDYNERLWAWEGWRSEVGKQLRP
Horse             ILNTMSTIYSTGKVCNPSNPQECLLLEPGLDAIMENSKDYNQRLWAWEGWRSEVGKQLRP
```

```
                    180s      190s      200s      210s      220s      230s
          90123456789012345678901234567890123456789012345678901234567890123456789012345678
Mammals
Human               LYEEYVVLKNEMARANHYEDYGDYWRGDYETEGSSGYEYSRNQLIEDVEHTFEEIKPLYE
Wombat              LYEEYVELKNEVAKGNDYEDYGDYWRADYEIEGSSESHYSRSQLIEDVEQIFLQIKPLYE
Common_vampire_bat  LYEEYVVLKNEMAREKNYEDYGDYWRGDYETEGSSGYEYSRNQLIEDVENTFAEIKPLYE
Mus_musculus        LYEEYVVLKNEMARANNYNDYGDYWRGDYEAEGADGYNYNRNQLIEDVERTFAEIKPLYE
Norway_rat          LYEEYVVLKNEMARANNYEDYGDYWRGDYEAEGVEGYNYNRNQLIEDVENTFKEIKPLYE
Big_brown_bat       LYEEYVVLKNEMARGNNYEDYGDYWRGDYETEGENGYNYSRSQLTEDVDRIFLEIKPLYE
Little_brown_bat    LYEEYVDLKNEMARGNNYEDYGDYWRGDYETEGEDGYNYSRNQLTEDVERIFLEIKPLYE
Black_flying_fox    FYEEYVVLKNEMARGENYEDYGDYWRGDYETEGINGSAYNRDQLIEDVDRTFAEIKPLYE
Large_flying_fox    FYEEYVVLKNEMARGENYEDYGDYWRGDYETEGTNGSAYNPSLGKLSSWAF-QIKPLYE
Rabbit              LYEEYVVLKNEMARANNYEDYGDYWRADYEAEGADGYDYSRSQLIDDVERTFSEIKPLYE
Pig                 LYEEYVVLENEMARANNYEDYGDYWRGDYEVTGTGDYDYSRNQLMEDVERTFAEIKPLYE
Cow                 LYEEYVVLENEMARANNYEDYGDYWRGDYEVTGAGDYDYSRDQLMKDVERTFAEIKPLYE
Sheep               LYEEYVVLENEMARANNYEDYGDYWRGDYEVTGAGDYDYSRDQLMKDVERTFEEIKPLYE
Yak                 LYEEYVVLENEMARANNYEDYGDYWRGDYEVTGAGDYDYSRDQLMKDVERTFAEIKPLYE
Sperm_whale         LYEEYVVLENEMARANNYEDYGDYWRGDYEVTGAGDYDYSRDQLITDVERTFAEIKPLYE
Narwhal             FYEEYVVLENEMARANNYEDYGDYWRGNYEVTGAGDYDYSRDQLITDVERTFAEIKPLYE
Orca                LYEEYVVLENEMARANNYEDYGDYWRGDYEVTGAGDYDYSRDQLIRDVERTFAEIKPLYE
Dog                 LYEEYVALKNEMARANNYEDYGDYWRGDYEEEWENGYNYSRNQLIDDVELTFTQIMPLYQ
Ferret              LYEEYVALKNEMARANNYEDYGDYWRGDYEEEWADGYSYSRNQLIEDVEHTFTQIKPLYE
Panda               LYEEYVALKNEMARANNYEDYGDYWRGDYEEEWTDGYNYSRNQLIEDVEHTFTQIKPLYE
California_sea_lion  LYEEYVALKNEMARANNYEDYGDYWRGDYEEEWTNGYNYSRDQLIKDVEQTFTQIQPLYE
Monk_seal           LYEEYVVLKNEMARANNYEDYGDYWRGDYEEEWPNGYNYSHDQLIKDVEQTFTQIQPLYE
Meerkat             LYEEYVALKNEMARANNYEDYGDYWRGDYEEEGADGYNYSRSQLIKDVERTFTQIKPLYV
Masked_palm_civet   LYEEYVALKNEMARANNYEDYGDYWRGDYEEEWTDGYNYSRNQLIQDVEDTFEQIKPLYQ
Puma                LYEEYVALKNEMARANNYEDYGDYWRGDYEEEWTDGYNYSRSQLIKDVEHTFTQIKPLYQ
Cat                 LYEEYVALKNEMARANNYEDYGDYWRGDYEEEWTDGYNYSRSQLIKDVEHTFTQIKPLYQ
Lynx                LYEEYVALKNEMARANNYEDYGDYWRGDYEEEWTDGYNYSRSQLIKDVEHTFTQIKPLYQ
Pangolin            LYEEYVVLKNEMARANHYEDYGDYWRGDYEAEGANGYNYSRDHLIEDVEHIFTQIKPLYE
Horse               LYEEYVVLKNEMARANNYEDYGDYWRGDYEAEGPSGYDYSRDQLIEDVERTFAEIKPLYE
```

```
                    240s       250s       260s       270s       280s       290s
Mammals             901234567890 12 3456789012 345678901234567890 1234567890 1234567890 1234567
Human               HLHAYVRAKLMNAY--PSYISPIGCLPAHLLGDMWGRFWTNLYSLTVPFGQKPNIDVTDAM
Wombat              HLHAYVRRRMMATY--GPLISETGGLPAHLLGDMWGRFWTNLYSLTVPYSGKPNIDVTQAM
Common_vampire_bat  HLHAYVRAKLMDTY--PSHISPTGCLPAHLLGDMWGRFWTNLYNLTAPFGEKPTIDVTAAM
Mus_musculus        HLHAYVRRKLMDTY--PSYISPTGCLPAHLLGDMWGRFWTNLYPLTVPFFAQKPNIDVTDAM
Norway_rat          QLHAYVRTKLMEVY--PSYISPTGCLPAHLLGDMWGRFWTNLYPLTTPFLQKPNIDVTDAM
Big_brown_bat       HLHAYVRAKLMDTY--PSRISPTGCLPAHLLGDMWGRFWTNLYNLTVPFFEQKPNIDVTDAM
Little_brown_bat    HLHAYVRAKLVNAY--PSRISPTGYLPAHLLGDMWGRFWTNLYNLTVPFFEQKPNIDVTGAM
Black_flying_fox    QLHAYVRAKLMDVY--PSHISPTGCLPAHLLGDMWGRFWINLYQLTVPFFEQKPNIDVTDEM
Large_flying_fox    QLHAYVRAKLMDAY--PSHISPTGCLPAHLLGDMWGRFWINLYQLTVPFFEQKPNIDVTDEM
Rabbit              QLHAFVRTKLMDAY--PSRISPTGCLPAHLLGDMWGRFWTNLYSLTVPFGQKPNIDVTDTM
Pig                 HLHAYVRAKLMDAY--PSRISPTGCLPAHLLGDMWGRFWTNLYPLTVPFFGEKPSIDVTEAM
Cow                 QLHAYVRAKLMHTY--PSYISPTGCLPAHLLGDMWGRFWTNLYSLTVPFFEHKPSIDVTEKM
Sheep               QLHAYVRAKLMDTY--PSYISPTGCLPAHLLGDMWGRFWTNLYSLTVPFFEHKPSIDVTEKM
Yak                 QLHAYVRAKLMHTY--PSYISPTGCLPAHLLGDMWGRFWTNLYSLTVPFFEHKPSIDVTEKM
Sperm_whale         QLHAYVRAKLMDAY--PSRISPTGCLPAHLLGDMWGRFWTNLYPLTVPFFGEKSSIDVTKEM
Narwhal             QLHAYVRAKLMDAY--PSRISPTGCIPAHLLGDMWGRFWTNLYPLTVPFFGERPSIDVTKEM
Orca                QLHAFVRAKLMDAY--PSRISPTGCLPAHLLGDMWGRFWTNLYPLTVPFFGERPSIDVTKEM
Dog                 HLHAYVRTKLMDTY--PSYISPTGCLPAHLLGDMWGRFWTNLYPLTVPFFGQKPNIDVTNAM
Ferret              HLHAYVRAKLMDAY--PSRISPTGCLPAHLLGDMWGRFWTNLYPLMVPFRQKPNIDVTDAM
Panda               HLHAYVRAKLMDTY--PSRISPTGCLPAHLLGDMWGRFWTNLYPLTIPFGQKPNIDVTHAM
California_sea_lion HLHAYVRAKLMDTY--PSHISPTGCLPAHLLGDMWGRFWTNLYPLTVPFGQKPNIDVTDTM
Monk_seal           HLHAYVRAKLMDTY--PSHISPTGCLPAHLLGDMWGRFWTNLYPLTVPFFGDKPNIDVTDTM
Meerkat             HLHAYVRRKLMATY--PSHISPTGCLPAHLLGDMWGRFWTNLYPLTVPFFGDKPNIDVTDAM
Masked_palm_civet   HLHAYVRAKLMDTY--PSRISRTGCLPAHLLGDMWGRFWTNLYPLTVPFFGQKPNIDVTDAM
Puma                HLHAYVRAKLMDTY--PSRISPTGCLPAHLLGDMWGRFWTNLYPLTVPFFGQKPNIDVTDAM
Cat                 HLHAYVRAKLMDTY--PSRISPTGCLPAHLLGDMWGRFWTNLYPLTVPFFGQKPNIDVTDAM
Lynx                HLHAYVRAKLMDTY--PSRISPTGCLPAHLLGDMWGRFWTNLYPLTVPFFGQKPNIDVTDAM
Pangolin            HLHAYVRAKLMDNY--PSHISPTGCLPAHLLGDMWGRFWTNLYPLTVPFRQKPNIDVTDAM
Horse               HLHAYVRAKLMDTY--PSHINPTGCLPAHLLGDMWGRFWTNLYSLTVPFGQKPNIDVTDAM
```

Mammals
Human                VDQAWDAQRIFKEAEKFFFVSVGLPNMTQGFWENSMLTDPGNVQKAVCHPTAWDLGKGDFR
Wombat               KDQNWNAQRIFEEAENFFVSVGLYNMTEGFWKNSMLTEPNDGRKVVCHPTAWDLGKGDFR
Common_vampire_bat   VDQSWDAQRIFKEAEKFFFKSVGLFSMTQGFWDNSMLTKPDDGREVVCHPTAWDLGNKDFR
Mus_musculus         MNQGWDAERIFQEAEKFFFVSVGLPHMTQGFWANSMLTEPADGRKVVCHPTAWDLGHGDFR
Norway_rat           VNQSWDAERIFKEAEKFFFVSVGLPQMTPGFWTNSMLTEPGDRKVVCHPTAWDLGHGDFR
Big_brown_bat        KEQSWDAEKIFKEAEKFYMSVGLPSMTPGFWNNSMLTEPGDGRKVVCHPTAWDLGKNDFR
Little_brown_bat     VEQSWDAEKIFKEAEKFYISVGLPSMTPGFWNNSMLTEPGDGRKVVCHPTAWDLGKGDFR
Black_flying_fox     VNQNWDEKRIFKEAEKFFFVSLGLPNMTEKFWEKSMLTEPGNDQKVACHPTAWDLGKGDFR
Large_flying_fox     VNQNWDEKRIFKEAEKFFFVSLGLPNMTEKFWEKSMLTEPGNDQKVACHPTAWDLGKGDFR
Rabbit               VNQGWDAERIFKEAEKFFFVSVGLPSMTQGFWENSMLTEPGDGRKVVCHPTAWDLGKGDFR
Pig                  VNQSWDAIRIFEEAEKFFFVSIGLPNMTQGFWNNSMLTEPGDGRKVVCHPTAWDLGKGDFR
Cow                  ENQSWDAERIFKEAEKFFFVSISLPYMTQGFWDNSMLTEPGDGRKVVCHPTAWDLGKGDFR
Sheep                KNQSWDAERIFKEAEKFFFVSIGLPYMTQGFWDNSMLTEPGDGRKVVCHPTAWDLGKGDFR
Yak                  ENQSWDAERIFKEAEKFFFVSISLPYMTQGFWDNSMLTEPGDGRKVVCHPTAWDLGKGDFR
Sperm_whale          RNQSWDAKRIFKEAEKFFFVSIGLPNMTQEFWDNSMLTEPGDGRKVVCHPTAWDLGKGDFR
Narwhal              QNQSWDAKRIFKEAEKFFFVSIGLPNMTQEFWDNSMLTEPGDGRKVVCHPTAWDLGKGDFR
Orca                 QNQSWDAKRIFKEAEKFFFVSIGLPNMTQGFWDNSMLTEPGDGRKVVCHPTAWDLGKGDFR
Dog                  VNQSWDARKIFKEAEKFFFVSVGLPNMTEGFWGNSMLTEPSDSRKVVCHPTAWDLGKGDFR
Ferret               VNQSWDARRIFEEAETFFVSVGLPNMTEGFWQNSMLTEPGDNRKVVCHPTAWDLGKRDFR
Panda                VNQNWDARRIFEEAEKFFFVSVGLPNMTQEFWENSMLTEPGDGQKVVCHPTAWDLGKGDFR
California_sea_lion   VNQSWDARRIFEEAEKFFFVSVGLPNMTQEFWENSMLTEPGDSRKVVCHPTAWDLGKHDFR
Monk_seal            VNQSWDARRIFEEAEKFFFVSVGLPNMTQGFWENSMLTEPGDGRKVVCHPTAWDLGKHDFR
Meerkat              VNQGWDARRIFREAEKFFFVSVGLPSMTQGFWDNSMLTEPGDGRKVVCHPTAWDLGKGDFR
Masked_palm_civet    VNQNWDARRIFKEAEKFFFVSVGLPNMTQGFWENSMLTEPGDGRKVVCHPTAWDLGKGDFR
Puma                 VNQSWDARRIFKEAEKFFFVSVGLPNMTQGFWENSMLTEPGDSQKVVCHPTAWDLGKGDFR
Cat                  VNQSWDARRIFKEAEKFFFVSVGLPNMTQGFWENSMLTEPGDSRKVVCHPTAWDLGKGDFR
Lynx                 VNQSWDARRIFKEAEKFFFVSVGLPNMTQGFWENSMLTEPGDSRKVVCHPTAWDLGKHDFR
Pangolin             VNQTWDANRIFKEAEKFFFVSVGLPKMTQTFWENSMLTEPGDGRKVVCHPTAWDLGKHDFR
Horse                VDQSWDAKRIFEEAEKFFFVSVGLPNMTQGFWENSMLTEPGDGRKVVCHPTAWDLGKGDFR
```

```
                        360s      370s      380s      390s      400s      410s
              8901234567890123456789012345678901234567890123456789012345678901234567
Mammals
Human               ILLMCTKVTMDDFLTAHHEMGHIQVDMAYAAQPFLLRNGANEGFHEAVGEIMSLSAATPKH
Wombat              IKMCTKVTMDDFLTAHHEMGHIQYDMAYASQPYLLRNGANEGFHEAVGEIMSLSAATPTH
Common_vampire_bat  IKMCTKVTMDDFLTAHHEMGHIQYDMAYANQSFLLRNGANEGFHEAVGEIMSLSVATPKH
Mus_musculus        IKMCTKVTMDNFLTAHHEMGHIQYDMAYARQPFLLRNGANEGFHEAVGEIMSLSAATPKH
Norway_rat          IKMCTKVTMDNFLTAHHEMGHIQYDMAYAKQPFLLRNGANEGFHEAVGEIMSLSAATPKH
Big_brown_bat       IKMCTKVTMDDFLTAHHEMGHIQYDMAYATQPYLLRNGANEGFHEAVGEVMSLSVATPKH
Little_brown_bat    IKMCTKVTMDDFLTAHHEMGHIQYDMAYATQPYLLRNGANEGFHEAVGEVMSLSVATPKH
Black_flying_fox    IIMCTKVKMEDFLTAHHEMGHIQYDMAYATQPYLLKNGANEGFHEAVGEVISLSVATPNH
Large_flying_fox    IIMCTKVKMEDFLTAHHEMGHIQYDMAYATQPYLLKNGANEGFHEAVGEVISLSVATPNH
Rabbit              IKMCTKVTMDNFLTAHHEMGHIQYDMAYATQPFLLRNGANEGFHEAVGEIMSLSAATPEH
Pig                 IKMCTKVTMDDFLTAHHEMGHIQYDMAYAIQPYLLRNGANEGFHEAVGEIMSLSAATPHY
Cow                 IKMCTKVTMDDFLTAHHEMGHIQYDMAYAAQPYLLRNGANEGFHEAVGEIMSLSAATPHY
Sheep               IKMCTKVTMDDFLTAHHEMGHIQYDMAYATQPYLLRNGANEGFHEAVGEIMSLSAATPHY
Yak                 IKMCTKVTMDDFLTAHHEMGHIQYDMAYATQPYLLRNGANEGFHEAVGEIMSLSAATPHY
Sperm_whale         IKMCTKVTMDDFLTARHEMGHIQYDMAYATQPYLLRNGANEGFHEAVGEIMSLSAATPHY
Narwhal             IKMCTKVTMDGFLTAHHEMGHIQYDMAYATQPYLLRNGANEGFHEAVGEIMSLSAATPHY
Orca                IKMCTKVTMDDFLTAHHEMGHIQYDMAYATQPYLFRNGANEGFHEAVGEIMSLSAATPHY
Dog                 IKMCTKVTMDDFLTAHHEMGHIQYDMAYAAQPFLLRNGANEGFHEAVGEIMSLSAATPNH
Ferret              IKMCTKVTMDDFLTAHHEMGHIQYDMAYAEQPFLLRNGANEGFHEAVGEIMSLSAATPNH
Panda               IKMCTKVTMDDFLTAHHEMGHIQYDMAYAEQPFLLRNGANEGFHEAIGEIMSLSAATPNH
California_sea_lion IKMCTKVTMDDFLTAHHEMGHIQYDMAYATQPFLLRNGANEGFHEAVGEIMSLSAATPKH
Monk_seal           IKMCTKVTMDDFLTAHHEMGHIQYDMAYAAQPFLLRNGANEGFHEAVGEIMSLSAATPKH
Meerkat             IKMCTKVTMDDFLTAHHEMGHIQYDMAVNAQPFLLRNGANEGFHEAVGEIMSLSAATPNH
Masked_palm_civet   IKMCTKVTMDDFLTAHHEMGHIQYDMAYAAQPFLLRNGANEGFHEAVGEIMSLSAATPNH
Puma                IKMCTKVTMDDFLTAHHEMGHIQYDMAYAVQPFLLRNGANEGFHEAVGEIMSLSAATPNH
Cat                 IKMCTKVTMDDFLTAHHEMGHIQYDMAYAVQPFLLRNGANEGFHEAVGEIMSLSAATPNH
Lynx                IKMCTKVTMDDFLTAHHEMGHIQYDMAVAMQPFLLRNGANEGFHEAVGEIMSLSAATPNH
Pangolin            IKMCTKVTMDDFLTAHHEMGHIQYDMAYAVQPYLLRNGANEGFHEAVGEIMSLSAATPKH
Horse               IKMCTKVTMDDFLTAHHEMGHIQYDMAYAVQPYLLRNGANEGFHEAVGEIMSLSAATPNH
```

```
                 420s       430s       440s       450s       460s       470s
        890123456789012345678901234567890123456789012345678901234567890123456789012345 67
Mammals
Human               LKSIGLLSPDFQEDNETEINFLLKQALTIVGTLPFTYMLEKWRWMVFFKGEIPKDQWMKKW
Wombat              LKALGLLPPTFQEDSDTDINFLFKQALTIVGTMPFTYMLEKWRWLVFKGEIPKEEWMKKW
Common_vampire_bat  LKVLGLLPPDFHEDNETDINFLLKQALNIVGTLPFTYMLEKWRWMVFRGEIPKEQWMKKW
Mus_musculus        LKSIGLLPSDFQEDSETEINFLLKQALTIVGTLPFTYMLEKWRWMVFRGEIPKEQWMKKW
Norway_rat          LKSIGLLPSNFQEDNETEINFLLKQALTIVGTLPFTYMLEKWRWMVFQDKIPREQWTKKW
Big_brown_bat       LKGMGLLPSDFSEDNETEINFLLKQALNIVGTLPFTYMLEKWRWMVFFKGEIPKEQWMKKW
Little_brown_bat    LKGMGLLPPDFSEDNETEINFLLKQALTIVGTLPFTYMLEKWRWMVFFKGEIPKEQWMKKW
Black_flying_fox    LKNMGLLPPDFYEDNETEINFLLKQALNVIGTLPFTYMLEKWRWMVFKGEIPKEQWMKKW
Large_flying_fox    LKNMGLLPPDFYEDNETEINFLLKQALNVIGTLPFTYMLEKWRWMVFKGEIPKEQWMKKW
Rabbit              LKSIGLLPYDFHEDNETEINFLLKQALTIVGTLPFTYMLEKWRWMVFKGEIPKEQWMQKW
Pig                 LKALGLLPPDFYEDSETEINFLLKQALTIVGTLPFTYMLEKWRWMVFKGEIPKEQWMQKW
Cow                 LKALGLLAPDFHEDNETEINFLLKQALTIVGTLPFTYMLEKWRWMVFKGEIPKQQWMEKW
Sheep               LKALGLLAPDFYEDNETEINFLLKQALTIVGTLPFTYMLEKWRWMVFKGEIPKQQWMEKW
Yak                 LKALGLLAPDFHEDNETEINFLLKQALTIVGTLPFTYMLEKWRWMVFKGEIPKQQWMEKW
Sperm_whale         LKALGLLPPDFYEDSATEINFLLKQALKIVGTLPFTYMLEKWRWMVFKGEIPKEQWMQKW
Narwhal             LKALGLLPPDFYEDRVTEINFLLKQALTIVGTLPFTYMLEKWRWMVFKGEIPKEQWMQKW
Orca                LKALGLLPPDFYEDSATEINFLLKQALTIVGTLPFTYMLEKWRWMVFKGEIPKEQWMQKW
Dog                 LKNIGLLPPSFFEDSETEINFLLKQALTIVGTLPFTYMLEKWRWMVFKGEIPKEQWMQKW
Ferret              LKNIGLLPPDFSEDSETDINFLLKQALTIVGTLPFTYMLEKWRWMVFKGEIPKDQWMKTW
Panda               LKNIGLLPPGFSEDNETEINFLLKQALTIVGTLPFTYMLEKWRWMVFQGKIPKEQWMKKW
California_sea_lion  LKTIGLLPPGFSEDNETDINFLFKQALTIVGTLPFTYMLEKWRWMVFKGEIPKEQWMKKW
Monk_seal           LKNIGLLPPGFSEDSETDINFLFKQALTIVGTLPFTYMLEKWRWMVFKGEIPKEQWIKKW
Meerkat             LKTIGLLSPAFSEDSETEINFLLKQALTIVGTLPFTYMLEKWRWMVFKGEIPKEQWMQKW
Masked_palm_civet   LKTIGLLSPAFSEDNETEINFLLKQALTIVGTLPFTYMLEKWRWMVFKGAIPKEQWMQKW
Puma                LKTIGLLSPGFSEDSETEINFLLKQALTIVGTLPFTYMLEKWRWMVFKGEIPKEQWMQKW
Cat                 LKTIGLLSPGFSEDSETEINFLLKQALTIVGTLPFTYMLEKWRWMVFKGEIPKEQWMQKW
Lynx                LKTIGLLSPGFSEDSETEINFLLKQALTIVGTLPFTYMLEKWRWMVFKGEIPKEQWMQKW
Pangolin            LKNIGLLPPDFYEDNETEINFLLKQALTIVGTLPFTYMLEKWRWMVFSGQIPKEQWMKKW
Horse               LKAIGLLPPDFYEDSETEINFLLKQALTIVGTLPFTYMLEKWRWMVFKGEIPKEEWMKKW
```

```
                            480s      490s      500s      510s      520s      530s
                    89012345678901234567890123456789012345678901234567890123456 7
Mammals
Human               WEMKREIVGVVEPVPHDETYCDPASLFHVSNDYSFIRYYTRTLYQFQFQEALCQAAKHEG
Wombat              WEMKRDIVGVVEPLPHDETYCDPATLFHVANDYSFIRYYTRTVYQFQFHEALCRIAQPSA
Common_vampire_bat  WEMKREIVGVVEPVPHDETYCDPATLFHVANDYSFIRYYTRTIFQFQFQEALCQTAQHEG
Mus_musculus        WEMKREIVGVVEPLPHDETYCDPASLFHVSNDYSFIRYYTRTIYQFQFQEALCQAAKYNG
Norway_rat          WEMKREIVGVVEPLPHDETYCDPASLFHVSNDYSFIRYYTRTIYQFQFQEALCQAAKHDG
Big_brown_bat       WEMKREIVGVVEPLPHDETYCDPASLFHVANDYSFIRYFTRTIFEFQFQEALCQIAKHQG
Little_brown_bat    WEMKRDIVGVMEPLPHDETYCDPASLFHVANDYSFIRYFTRTIFEFQFQEALCQIAKHQG
Black_flying_fox    WEMKRELVGVVEPLPHDETYCDPASLFHVANDYSFIRYYTRTIFEFQFQEALCRIAQHEG
Large_flying_fox    WEMKRELVGVVEPLPHDETYCDPASLFHVANDYSFIRYYTRTIFEFQFQEALCRIAQHEG
Rabbit              WEMKREIVGVVEPMPHDETYCDPAALFHVANDYSFIRYYTRTIYQFQFQEALCQAAQHEG
Pig                 WEMKREIVGVVEPLPHDETYCDPACLFHVAEDYSFIRYYTRTIYQFQFHEALCRTAKHEG
Cow                 WEMKREIVGVVEPLPHDETYCDPACLFHVAEDYSFIRYYTRTIYQFQFHEALCKTAKHEG
Sheep               WEMKREIVGVVEPLPHDETYCDPACLFHVAEDYSFIRYYTRTIYQFQFHEALCKTAKHEG
Yak                 WEMKREIVGVVEPLPHDETYCDPACLFHVAEDYSFIRYYTRTIYQFQFHEALCKTAKHEG
Sperm_whale         WEMKREIVGVVEPLPHDETYCDPACLFHVAEDYSFIRYYTRTIYQFQFHEALCQAAKHEG
Narwhal             WEMKREIVGVVEPLPHDETYCDPACLFHVAEDYSFIRYYTRTIYQFQFHEALCQTAKHEG
Orca                WEMKREIVGVVEPLPHDETYCDPACLFHVAEDYSFIRYYTRTIYQFQFHEALCQTAKHEG
Dog                 WEMKRNIVGVVEPVPHDETYCDPASLFHVANDYSFIRYYTRTIYQFQFQEALCQIAKHEG
Ferret              WEMKRDIVGVVEPLPHDETYCDPAALFHVANDYSFIRYYTRTIYQFQFQEALCQIAKHEG
Panda               WEMKRDLVGVVEPLPHDETYCDPASLFHVANDYSFIRYYTRTIYQFQFQEALCQIAKHEG
California_sea_lion WEMKRDLVGVVEPLPHDETYCDPASLFHVANDYSFIRYYTRTIYQFQFQEALCQIAKHEG
Monk_seal           WEMKRDLVGVVEPLPHDETYCDPASLFHVANDYSFIS-----------------------
Meerkat             WEMKRDIVGVVEPVPHDETYCDPASLFHVANDYSFIRYYTRTIYQFQFQEALCRIAKHQG
Masked_palm_civet   WEMKRNIVGVVEPLPHDETYCDPASLFHVANDYSFIRYYTRTIYQFQFQEALCRIAKHEG
Puma                WEMKREIVGVVEPVPHDETYCDPASLFHVANDYSFIRYYTRTIYQFQFQEALCRIAKHEG
Cat                 WEMKREIVGVVEPVPHDETYCDPASLFHVANDYSFIRYYTRTIYQFQFQEALCRIAKHEG
Lynx                WEMKREIVGVVEPVPHDETYCDPASLFHVANDYSFIRYYTRTIYQFQFQEALCRIAKHEG
Pangolin            WEMKREIVGVVEPVPHDETYCDPASLFHVANDYSFIRYYTRTIYQFQFQEALCQTAKHEG
Horse               WEMKREIVGVVEPVPHDETYCDPAALFHVANDYSFIRYYTRTIYQFQFQEALCQTAKHEG
```

FIGURE 3
J.

```
                540s      550s      560s      570s      580s      590s
        890123456789012345678901234567890123456789012345678901234567
Mammals
Human              PLHKCDISNSTEAGQKLFNMLRLGKSEPWTLALENVVGAKNMNVRPLLNYFEPLFTWLKD
Wombat             ALHKCDITNSTAAGTKLLDMLKLGKSEPWTVALENMVGNKRMNATPLLEYFEPLFTWLKE
Common_vampire_bat PLHKCDISNSTAAGEKLLQMLKLGKSEPWTRALENIVGKKQMDVRPLLNYFEPLFTWLKE
Mus_musculus       SLHKCDISNSTEAGQKLLKMLSLGNSEPWTKALENVVGARNMDVKPLLNYFQPLFDWLKE
Norway_rat         PLHKCDISNSTEAGQKLLNMLSLGNSGPWTLALENVVGSRNMDVKPLLNYFQPLFVWLKE
Big_brown_bat      PLHKCDISNSTEAGNKLLEMLKLGKSKPWTFALEKITGTKKMDAKPLLNYFEPLFTWLKE
Little_brown_bat   PLHKCDISNSKEAGNKLLEMLKLGKSEPWTLALDKIVGTKKMDAKPLLNYFEPLFTWLKE
Black_flying_fox   PLYKCDISNSTEAGKKLHEMLSFGKSKPWTLALESIVGTKNMDVRPLLNYFEPLFTWLKD
Large_flying_fox   PLYKCDISNSTEAGKKLHEMLSFGKSKPWTLALESIVGTKNMDVRPLLNYFEPLFTWLKD
Rabbit             PLHKCDISNSTEAGQKLLNMLRLGRSEPWTLALENVVGAKNMDVRPLLNYFEPLFTWLKE
Pig                PLYKCDISNSTEAGQKLLQMLSLGKSEPWTLALENIVGVKTMDVKPLLSYFEPLLTWLKA
Cow                ALFKCDISNSTEAGQRLLQMLRLGKSEPWTLALENIVGIKTMDVKPLLNYFEPLFTWLKE
Sheep              ALFKCDISNSTEAGQRLLQMLRLGKSEPWTLALENIVGIKTMDVKPLLNYFEPLFTWLKE
Yak                ALFKCDISNSTEAGQRLLQMLRLGKSEPWTLALENIVGIKTMDVKPLLNYFEPLFTWLKE
Sperm_whale        PLYKCDISNSTEAGQRLLQMLHLGKSEPWTSALENIVGVKTMDVKPLLNYFEPLLTWLKD
Narwhal            PLYKCDISNSTEAGQRLLQMLRLGKSEPWTSALESIAGVKTMDVKPLLNYFEPLLTWLKD
Orca               PLYKCDISNSTEAGQRLLQMLHLGKSEPWTSALERIVGVKTMDVKPLLNYFEPLLTWLKE
Dog                PLHKCDISNSSEAGQKLLEMLIKLGKSEPWTYALEIVVGAKNMDVRPLLNYFEPLFTWLKE
Ferret             PLYKCDISNSSEAGQKLHEMLSLGRSKPWTFALERVVGAKTMDVRPLLNYFEPLFTWLKE
Panda              PLHKCDISNSSEAGKTLLQMLRLGRSKPWTLALERVVGAKNMDVRPLLNYFEPLFTWLKE
California_sea_lion PLHKCDISNSSEAGQTLLQMLKLGRSKPWTLALYRVVGAKNMDVRPLLNYFDPLFTWLKE
Monk_seal          ---------------QMLKLGRSKPWTLALYNVVGAKNMDVRPLLNYFDPLFTWLKE
Meerkat            PLHKCDISNSTEAGKKLLEMLSLGRSEPWTLALEQVVGAKNMDERPLLNYFEPLFTWLKE
Masked_palm_civet  PLHKCDISNSTEAGKKLLEMLSLGRSEPWTLALERVVGAKNMNVTPLLNYFEPLFTWLKE
Puma               PLHKCDISNSIEAGKKLLQMLTLGKSKPWTLALEHVVGEKNMNVTPLLKYFEPLFTWLKE
Cat                PLHKCDISNSSEAGKKLLQMLTLGKSKPWTLALEHVVGEKKMNVTPLLKYFEPLFTWLKE
Lynx               PLHKCDISNSSEAGKKLLQMLTLGKSKPWTLALEHVVGEKNMNVTPLLKYFEPLFTWLKE
Pangolin           PLHKCDISNSAEAGQKLLQMLSLGKSKPWTLALERVGTKNMDVRPLLNYFEPLLTWLKE
Horse              PLHKCDISNSTEAGQKLLQMLSLGKSEPWTLALERIVGVKNMDVRPLLNYFEPLFTWLKD
```

FIGURE 3
K.

```
                                           600s          610s          620s          630s
                                           8901234567    8901234567890123456789012345678901234567890 1
Mammals
Human                   QNKINSFVGWS------------TDWSPYADQSIKVRISLKSALGDKAYEWNDNEMY
Wombat                  QNKNAYVGWN-------------TDWSPYNEYSIKVRISLKSALGENAYDWNENEMY
Common_vampire_bat      QNRNSFVGWL------------TDWSPYAAESIKVRISLKSALGDKAYEWNDNEMY
Mus_musculus            QNRNSFVGWN------------TEWSPYADQSIKVRISLKSALGANAYEWTNNEMF
Norway_rat              QNRNSTVGWS------------TDWSPYADQSIKVRISLKSALGKNAYEWTDNEMY
Big_brown_bat           QNGNS-VGWH------------SD------ADQSIKVRISLKSALGEKAYEWNDNEMY
Little_brown_bat        QNGNS-VGWNSGNSVESRSGNSVGWFSDWSPYAEQSIKVRISLQSALGEKAYKWNDNEMY
Black_flying_fox        QNRNSFVGWR------------TDWSPYADQSIKVRISLKSALGENAYEWNDNEMY
Large_flying_fox        QNRNSFVGWR------------TDWSPYADQSIKVRISLKSALGDNAYEWNDNEMY
Rabbit                  QNRNSFVGWS------------TEWTPYADQSIKVRISLKTALGDQAYEWNDSEMY
Pig                     QNGNSSVGWN------------TDWTPYADQSIKVRISLKSALGEDAYEWNDNEMY
Cow                     QNRNSFVGWS------------TEWTPYSDQSIKVRISLKSALGENAYEWNDNEMY
Sheep                   QNRNSFVGWS------------TEWTPYSDQSIKVRISLKSALGENAYEWNDNEMY
Yak                     QNRNSFVGWS------------TEWTPYSDQSIKVRISLKSALGENAYEWNDNEMY
Sperm_whale             QNRNSFVGWS------------TDWTPYSDQSIKVRISLKSALGEKAYEWNDNEMY
Narwhal                 QNRNSFVGWN------------TDWTPYSDQSIKVRISLKSALGEKAYEWNDNEMY
Orca                    QNRNSFVGWR------------TDWTPYSNQSIKVRISLKSALGEKAYEWNDNEMY
Dog                     QNRNSFVGWN------------TDWSPYADQSIKVRISLKSALGEKAYEWNNNEMY
Ferret                  QNRNSFVGWN------------TDWSPYADQSIKVRISLKSALGEKAYEWNDNEMY
Panda                   QNRNSFVGWN------------TDWSPYADQSIKVRISLKSALGKEAYEWNDNEMY
California_sea_lion     QNRNSFVGWN------------TDWSPYADQSIKVRISLKSALGEKAYEWNDNEMY
Monk_seal               QNRNSFVGWN------------TDWSPYADQSIKVRISLKSALGEKAYKWNDNEMY
Meerkat                 QNRNSFVGWN------------TEWFPHADQSIKVRISLKSALGEKAYEWNDNEMY
Masked_palm_civet       QNRNSFVGWD------------TDWRPYSDQSIKVRISLKSALGEKAYEWNDNEMY
Puma                    QNRNSFVGWN------------TDWRPYADQSIKVRISLKSALGDEAYEWNDNEMY
Cat                     QNRNSFVGWN------------TDWRPYADQSIKVRISLKSALGDEAYEWNDNEMY
Lynx                    QNRNSFVGWN------------TDWRPYADQSIKVRISLKSALGDEAYEWNDNEMY
Pangolin                QNKNSFVGWN------------TDWSPYAAQSIKVRISLKSALGEKAYEWNDSEMY
Horse                   QNKNSFVGWS------------TNWSPYADQSIKVRISLKSALGEKSYEWNDNEMY
```

FIGURE 3
L.

```
                640s       650s       660s       670s       680s       690s
       2345678901234567890123456789012345678901234567890123456789012345678901
Mammals
Human               LFRSSVAYAMRQYFLKVKNQMILFGEEDVRVANLKPRISFNFFVTAPKNVSDIIPRTEVE
Wombat              LFQAVIAFAMRQYFFQKKKETIPFRDENVKVFDLKPRISFYFFVTAPPNGSHV-PREDVE
Common_vampire_bat  FFRSSIAYAMREYFSNFKNQTIPFFRAEDVWVSDLKPRVSFNFFVTSPNSVSDIIPRSEVE
Mus_musculus        LFRSSVAYAMRKYFSIIKNQTVPFLEEDVRVSDLKPRVSFYFFVTSPQNVSDVIPRSEVE
Norway_rat          LFRSSVAYAMREYFSREKNQTVPFGEADVWVSDLKPRVSFNFFVTSPKNVSDIIPRSEVE
Big_brown_bat       LFRSSVAYAMREYFLKVKNQTIPFFRAEDVWVNDVKPRVSFKFFVTSPTNMSDIIPRSEVE
Little_brown_bat    LFQSSVAYAMREYFLKEKNQTIPFGVENVRVNDIKPRVSFKFYVTSPKNMSVVIPRSEVE
Black_flying_fox    LFKSSVAFAMREYFLKVKNLTIPFGEDDVWVSDLKPRISFNFFVTSPNNVSDIIPRTEVE
Large_flying_fox    LFKSSIAYAMREYFLKVKNLTIPFGEDDVWVSDLKPRISFNFFVTSPNNVSDFIPRTEVE
Rabbit              LFRSSVAYAMRKYFSEVKNQTILFGEEDVRVSDLKPRISFNFFVTAPNNVNDIIPRNEVE
Pig                 LFRSSIAYAMRNYFSSAKNETIPFGAVDVWVSDLKPRISFNFFVTSPANMSDIIPRSDVE
Cow                 LFQSSVAYAMRKYFSEARNETVLFGEDNVWVSDKKPRISFKFFVTSPNNVSDIIPRTEVE
Sheep               LFRSSVAYAMRKYFLKERNETIPFGEENVWVSDKKPRISFKFFVTSPNNVSDIIPRTEVE
Yak                 LFQSSVAYAMRKYFSEARNETVLFGEDNVWVSDKKPRISFKFFVTSPNNVSDIIPRTEVE
Sperm_whale         LFRSSVAYAMREYFSKVRNETIPFGEEDVRVGDLKPRISFTFFVTSPKNVSDIIPRTEVE
Narwhal             LFRSSVAYAMREYFSKVRNETIPFGGEDVRVSDLKPRISFNFFVTSPKNMSDIIPRTEVE
Orca                LFRSSVAYAMREYFSKVRNKTIPFGEKDVWVSDLKPRISFNFFVTSPKNMSDIIPRTEVE
Dog                 LFRSSIAYAMREYFSEVKNQTIPFFVEDNVWVVSDLKPRISFNFSVTSPGNVSDIIPRTEVE
Ferret              FFQSSIAYAMRQYFSEVKNQTIPFVGKDVRVSDLKPRISFNEIVTSPENMSDIIPRADVE
Panda               LFRSSIAYAMRKYFSEAKTQTIPFVEDNVWVSNLKPRISFNFFVTSPGNVSDVIPRADVE
California_sea_lion LFRSSIAYAMREYFSKVKNQMIPFVEDNVWVNNLKPRISFTFFVTSPGNMSDIIPRADVE
Monk_seal           LFRSSIAYAMREYFSKVKNQMIPFVEDNVWVNDLKPRISFNFFVTLPGNVSDIIPRADVE
Meerkat             LFRSSIAYAMREYFNKEKKQTIPFFVEDNVWVTNLKPRISFNFFVTSYKNVSDIIPRSEVE
Masked_palm_civet   LFRSSVAYAMREYFSKVKNQMIPFVEDNVWVSNLKPRISFNFFVTFSNNVSDVIPRSEVE
Puma                LFRSSVAYAMREYFSKVKNQMIPFVEDNVWVSNLKPRISFNFFVTASKNVSDVIPRSEVE
Cat                 LFRSSVAYAMREYFSKVKNQTIPFVEDNVWVSNLKPRISFNFFVTASKNVSDVIPRSEVE
Lynx                LFRSSVAYAMREYFSKVKNQTIPFVEDNVWVSNLKPRISFNFFVTASKNVSDVIPRSEVE
Pangolin            LFRSSSVAYAMREYFSKVKKQTIPFEDECVRVSDLKPRVSFIFFVTLPKNVSAVIPRAEVE
Horse               LFQSSVAYAMRVYFLKAKNQTILFGEEDVWVSDLKPRISFNFFVTSPKNASDIIPRTDVE
```

```
                    700s      710s      720s      730s      740s      750s
       23456789012345678901234567890123456789012345678901234567890123456789012345678901
Human               KAIRMSRSRINDAFRLNDNSLEFLGIQPTLGPPNQPPVSIWLIVFGVVMGVIVFGVIVILLI
Wombat              EAIRHSRGRINDAFRLNDNSLEFVGIPTTLAPPSEPPVTAWLIAFGVVMGMVMIGILFLI
Common_vampire_bat  EAIRKSRSRINDAFRLDDNSLEFLGIQPTLEPPYQPAVTIWLIAFGVVMGLVVVGIGVLI
Mus_musculus        DAIRMSRGRINDVFGLNDNSLEFLGIHPTLEPPYQPPVTIWLIIFGVVMALVVVGIIILI
Norway_rat          EAIRMSRGRINDIFGLNDNSLEFLGIYPTLKPPYEPPVTIWLIIFGVVMGTVVVGIVLLI
Big_brown_bat       DAIRMSRSRINAAFRLDDNSLEFLGIQPTLGPPYQPPVTIWLIVFGVVMGVVVIGIGVLI
Little_brown_bat    DAIRMSRSRINDAFRLDDNTLEFLGIQPTLGPPNQPPVTIWLIVFGVVMGVAVIGIAVLI
Black_flying_fox    EGIRMSRGRINDAFRLDDNSLEFLGIEPTLGTPYQPPVTIWLIVFGVVMGLVVVGIVLLI
Large_flying_fox    EAIRMSRGRINDAFRLDDNSLEFLGIEPTLEPPYQPPVTIWLIVFGVVMGLVVVGIVLLI
Rabbit              EAISMSRSRINDIFRLDDNSLEFVGIQPTLEPPYESPVPIWLVVFGVVMGMIVIGIVVLI
Pig                 KAISMSRSRINDAFRLDDNTLEFLGIQPTLGPPDEPPVTVWLIIFGVVMGLVVVGIVVLI
Cow                 NAIRLSRDRINDVFQLDDNSLEFLGIQPTLGPPYEPPVTIWLIIFGVVMGVVVIGIVVLI
Sheep               NAIRLCRDRINDAFQLDDNSLEFLGIQPTLRPPYEPPVTIWLIIFGVVMGVVVIGIVVLI
Yak                 NAIRLSRDRINDVFQLDDNSLEFLGIQPTLGPPYEPPVTIWLIIFGVVMGVVVIGIVVLI
Sperm_whale         EAIRMSRGRINDAFRLDDNSLEFLGIEPTLGPPYEPPVTIWLIIFGVVMGVVVIGIAVLS
Narwhal             EAIRMSRGRINDAFRLDDSSLEFLGVQPTLAPPYEPPVTVWLIIFGVVMGVVVIGIVVLI
Orca                EAIRMSRGRINDAFRLDDSSLEFLGVQPTLAPPYEPPVTVWLIIFGVVMGVVVIGIVVLI
Dog                 EAIRMYRSRINDVFRLDDNSLEFLGIQPTPGPPYEPPVTIWLIVFGVVMGVVVVGIVILLI
Ferret              EAIRKSRSRINDAFRLDDNSLEFLGIQPTLEPPYQPPVTIWLIVFGVVMGVVVVGIFLLI
Panda               DAIKMSRDRINDAFRLDDNSLEFLGIQPTLGPPYQPPVTIWLIVFGVVMGLVVVGIILLI
California_sea_lion EAIRMSRGRINDAFRLDDNSLEFLGIQPTLEPPYQPPVTIWLIVFGVVMAVVVGIVLLI
Monk_seal           EAIRMSRGRINDAFRLDDKSLEFLGIQPTLGPPYQPPVTIWLIVFGAVMGVVVGIVLLI
Meerkat             AAIRMSRSRINDAFRLDDNSLEFLGIQPTLSPPYQPPVTIWLIVFGVVMGVVVGIVLLI
Masked_palm_civet   DAIRMSRSRINDAFRLDDNSLEFLGIEPTLSPPYRPPVTIWLIVFGVVMGAIVVGIVLLI
Puma                EAIRMSRSRINDAFRLDDNSLEFLGIQPTLSPPYQPPVTIWLIVFGVVMGVVVGIVLLI
Cat                 EAIRMSRSRINDAFRLDDNSLEFLGIQPTLSPPYQPPVTIWLIVFGVVMGVVVVGIVLLI
Lynx                EAIRISRSRINDAFRLDDNSLEFLGIQPTLSPPYQPPVTIWLIVFGVVMGVVVGIVLLI
Pangolin            EAIRISRSRINDAFRLDDNSLEFLGIQPTLQPPYQPPVTIWLIVFGVVMGVVVGIVVLI
Horse               EAIRMSRSRINDAFRLDDNTLEFLGIQPTLGPPYQPPVTVWLIAFGVVMGLVVVGIVVLI
```

Mammals

```
                      760s         770s      901        780s          790s
                      2345678901 2 345678    901        2345678901 23 456789012 2
Mammals
Human               FTGIRDRKKKN---KARSGE------NPY-------ASIDISKGENNP--GFQNTDDVQ
Wombat              YTGIRDRKKRNKSQEAKRAE------NPY-------AEVHSIGGQHNA--GFQNTEDVQ
Common_vampire_bat  FTGIRERKRKS---QETSEE------NPY-------SSMNLSKGESNP--GFQNGDDVQ
Mus_musculus        VTGIKGRKKKN---ETKREE------NPY-------DSMDIGKGESNA--GFQNSDDAQ
Norway_rat          VTGIKGRKKKN---ETKREE------NPY-------DSMDIGKGESNA--GFQNSDDAQ
Big_brown_bat       FTGIRDRKKKN---QPGNEE------NPY-------SSVNLSKGENNP--GFQSGDDVQ
Little_brown_bat    FTGIRDRKKKK---QAGNEE------NPY-------SSVNLSKGENNP--GFQNGDDVQ
Black_flying_fox    FAGIRDRRKKN---QERSEE------NPY-------SSVDLSKGENNP--GFQNNDDVQ
Large_flying_fox    FAGIRDRRKKN---QERSEE------NPY-------SSVDLSKGENNP--GFQNNDDVQ
Rabbit              FTGIKDRRKQK---QAKREE------NPY-------GFVDMSKGENNS--GFQNSDDIQ
Pig                 FTGIRDRRKKK---QASSEE------NPY-------GSMDLSKGESNS--GFQNGDDIQ
Cow                 FTGIRNFRKHD---NDGLQN------DENLRVQQQAVKVDISRNSLKAPVPFSNSHEKL
Sheep               FTGIRDQRKKN---QASSEE------NPY-------GSVDLNKGENNS--GFQNTDDVQ
Yak                 FTGIRDRRKKN---QASSEE------NPY-------GSVDLNKGENNS--GFQNTDDVQ
Sperm_whale         FTGIRDRRKKN---RASTEE------NPY-------GSVDLSKGENNS--GFQNSDDVQ
Narwhal             FTGIRDRRKKN---QASSEE------NPY-------DSVGLSKGENNS--GFQNSDDVQ
Orca                FTGIRDRRKKN---QASSEE------NPY-------GSVGLSKGENNP--GFQNSDDVQ
Dog                 FSGIRNRRKND---QARGEE------NPY-------ASVDLSKGENNP--GFQSGDDVQ
Ferret              FSGIRNRRKNN---QARSEE------NPY-------ASVDLSKGENNP--GFQNVDDVQ
Panda               FSGIRNRRKND---QARSEE------NPY-------ASVDLSKGENNP--GFQNADDVQ
California_sea_lion FSGIRSRRKND---QATSEE------NPY-------ASVNLSKGENNP--GFQNVDDVQ
Monk_seal           FSGIRNRRKND---QARSEE------NPY-------ASVNLSKGENNP--GFQNVGAVQ
Meerkat             VSGIRSRKKKT---QARSDE------NPY-------ASEDLSKGENNA--GFQHVDDAQ
Masked_palm_civet   VSGIRNRRKND---QAGSEE------NPY-------ASVDLNKGENNP--GFQHADDVQ
Puma                VSGIRNRRKNN---QARSEE------NPY-------ASVDLSKGENNP--GFQHADDVQ
Cat                 VSGIRNRRKNN---QARSEE------NPY-------ASVDLSKGENNP--GFQHADDVQ
Lynx                VSGIRNRRKNN---QARSEE------NPY-------ASVDLSKGENNP--GFQHADDVQ
Pangolin            FTGIRDRKKKD---QARSEQ------NPY-------ASVDLSKGENNP--GFQNVDDVQ
Horse               ATGIRGRRKKN---QARSEE------NPY-------ASVDLSKGENNP--GFQNGDDVQ
```

| Mammals | 800s 3 45 |
|---|---|
| Human | T-SF |
| Wombat | T-SF |
| Common_vampire_bat | T-SF |
| Mus_musculus | T-SF |
| Norway_rat | T-SF |
| Big_brown_bat | T-SF |
| Little_brown_bat | T-SF |
| Black_flying_fox | T-SF |
| Large_flying_fox | T-SF |
| Rabbit | T-SF |
| Pig | T-SF |
| Cow | K--- |
| Sheep | T-SL |
| Yak | T-SL |
| Sperm_whale | T-SF |
| Narwhal | T-SF |
| Orca | T-SF |
| Dog | T-SF |
| Ferret | T-SF |
| Panda | T-SF |
| California_sea_lion | TSSF |
| Monk_seal | T-SF |
| Meerkat | T-SF |
| Masked_palm_civet | T-SF |
| Puma | T-SF |
| Cat | T-SF |
| Lynx | T-SF |
| Pangolin | T-SF |
| Horse | T-SF |

FIGURE 4
A.
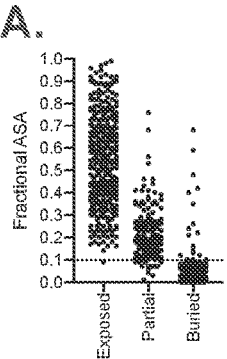
B.
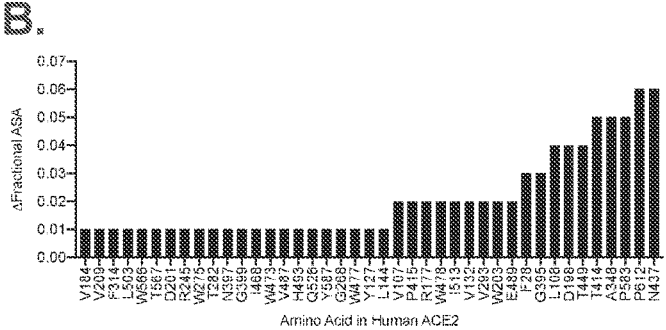
C.
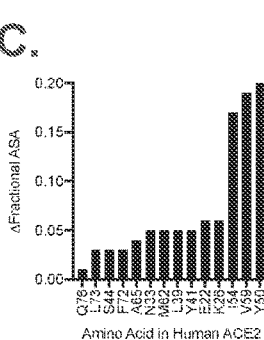
D.
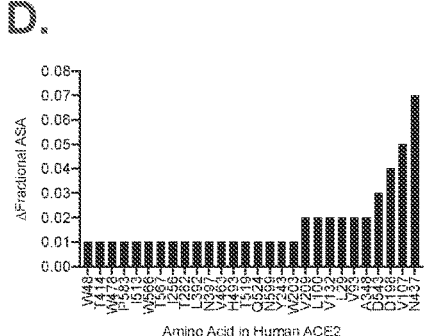
E.
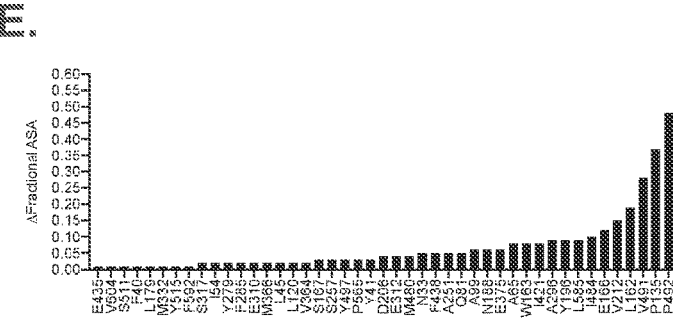

FIGURE 5
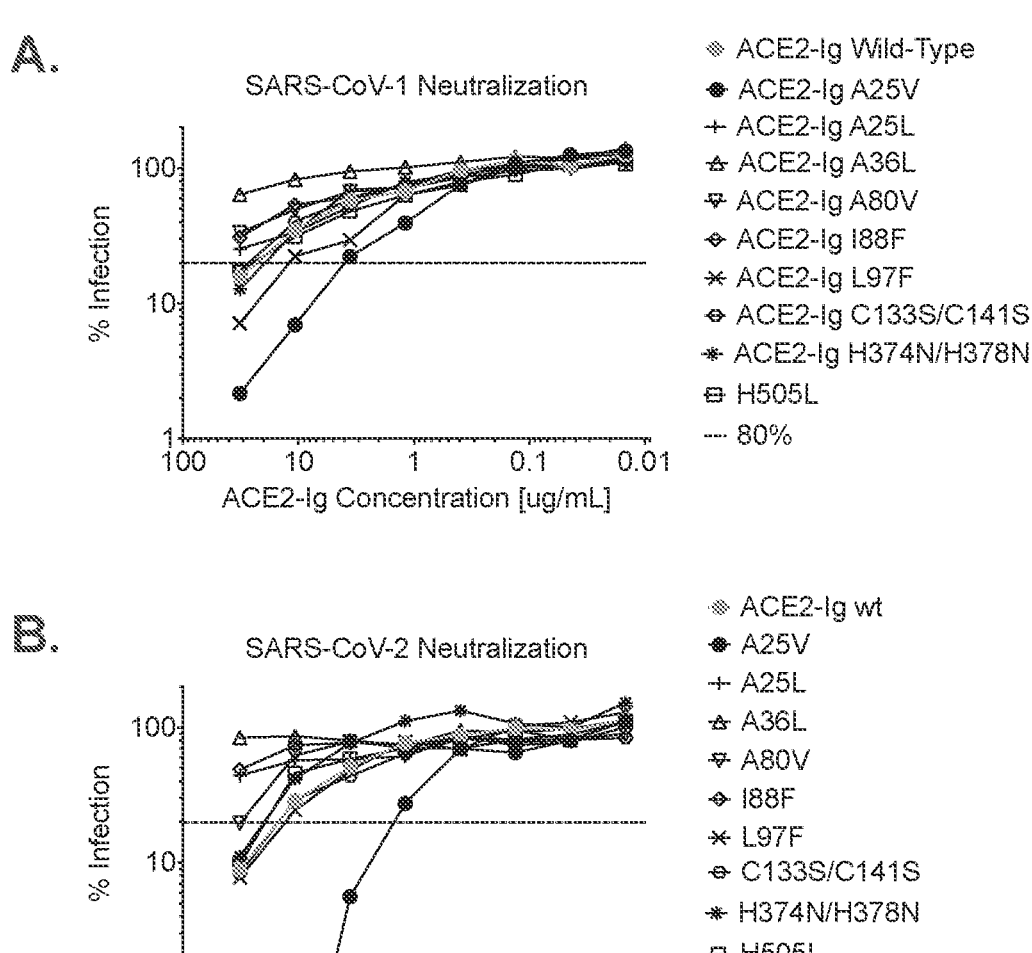
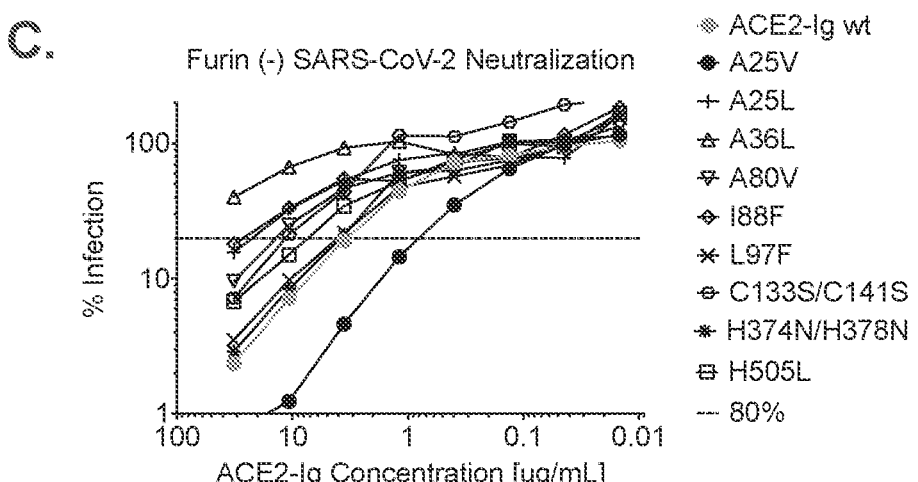

FIGURE 5
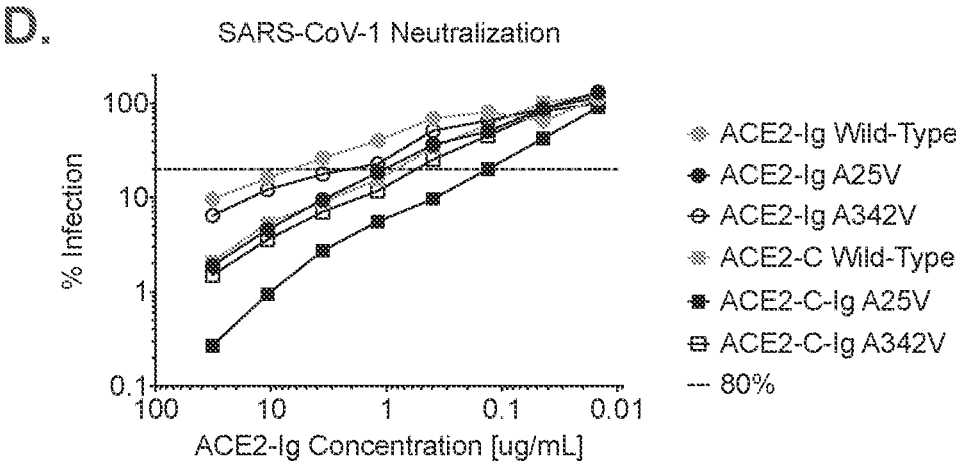
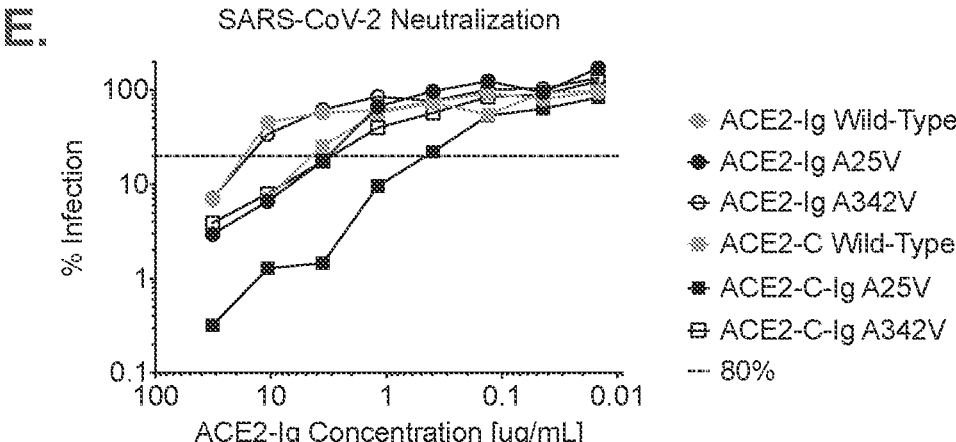
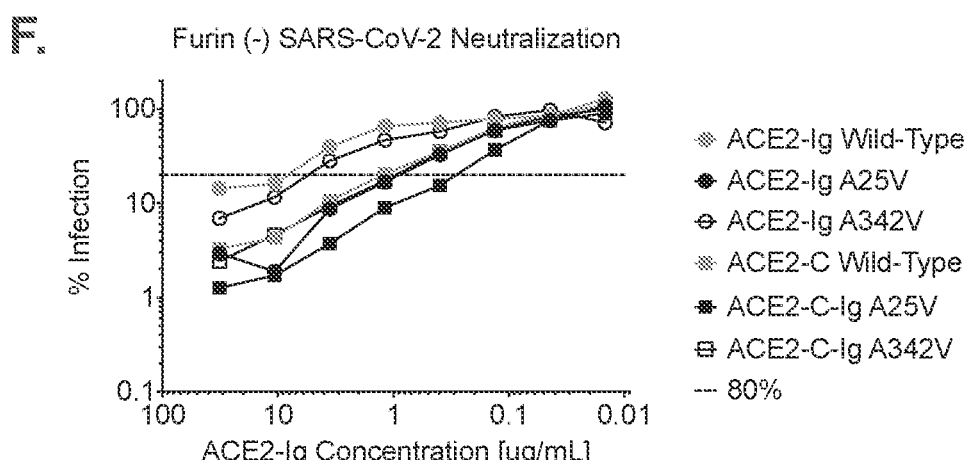

FIGURE 5
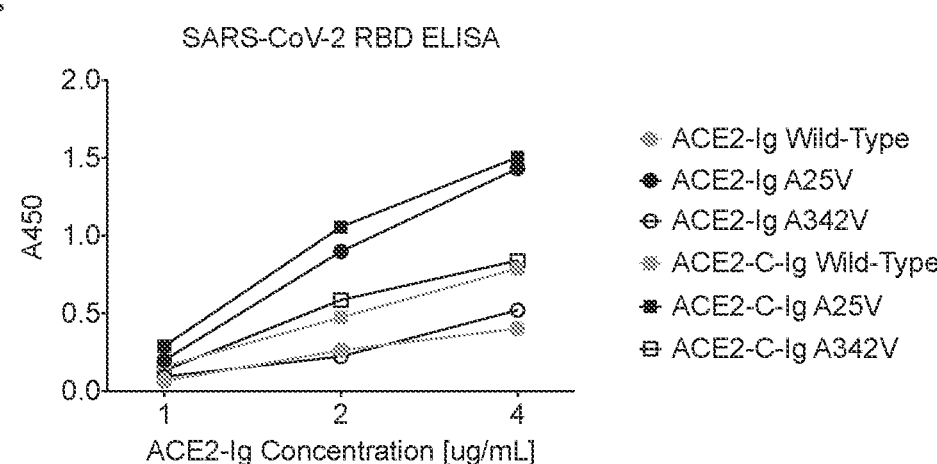
SARS-CoV-2 RBD ELISA
ACE2-Ig Wild-Type
ACE2-Ig A25V
ACE2-Ig A342V
ACE2-C-Ig Wild-Type
ACE2-C-Ig A25V
ACE2-C-Ig A342V
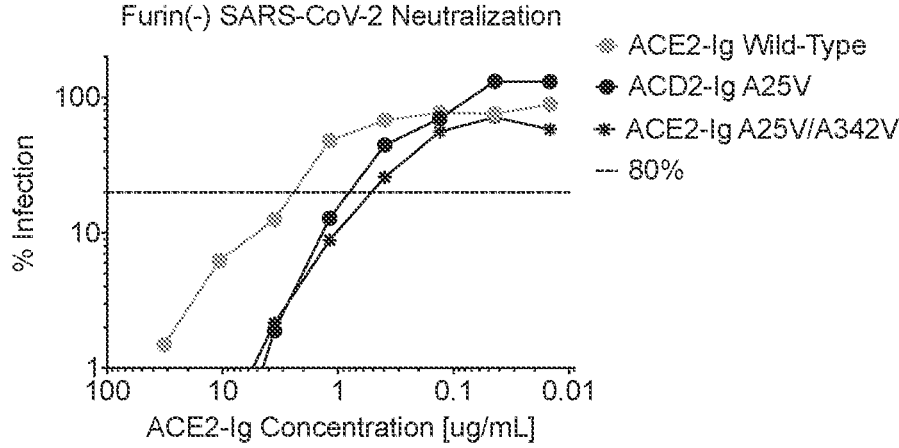
Furin(-) SARS-CoV-2 Neutralization
ACE2-Ig Wild-Type
ACD2-Ig A25V
ACE2-Ig A25V/A342V
80%

FIGURE 6
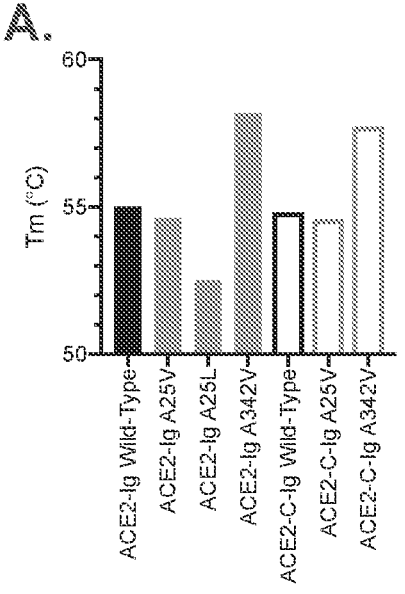
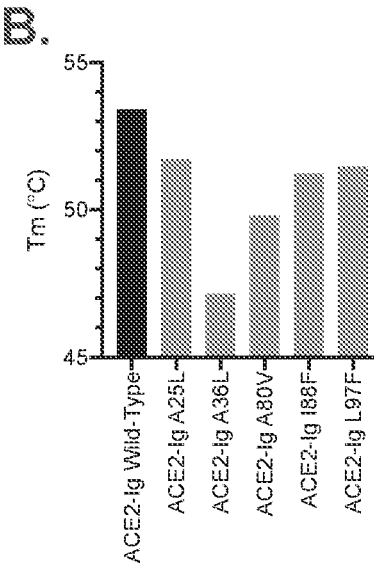

FIGURE 7
A.
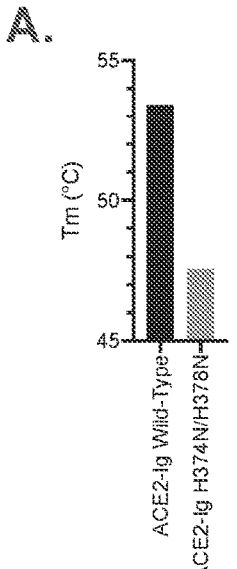
B.
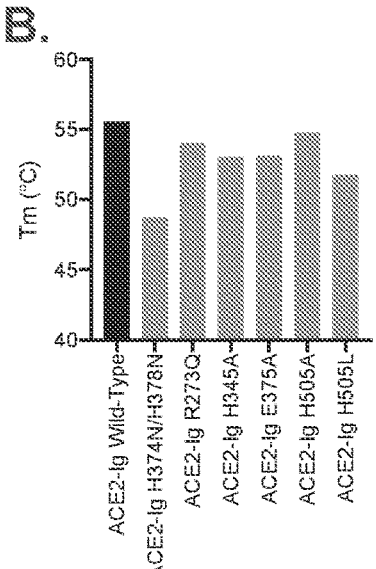
C.
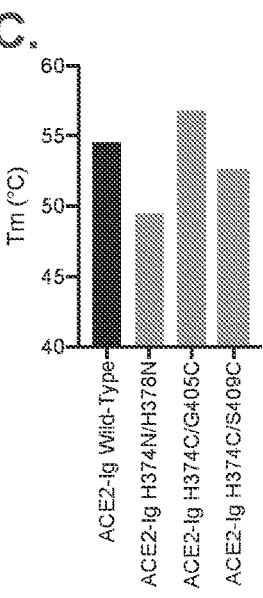

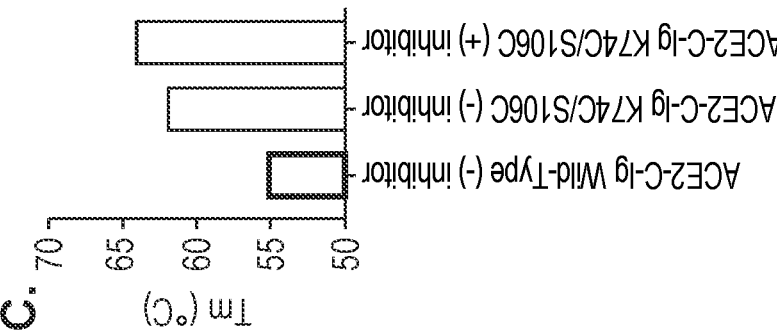
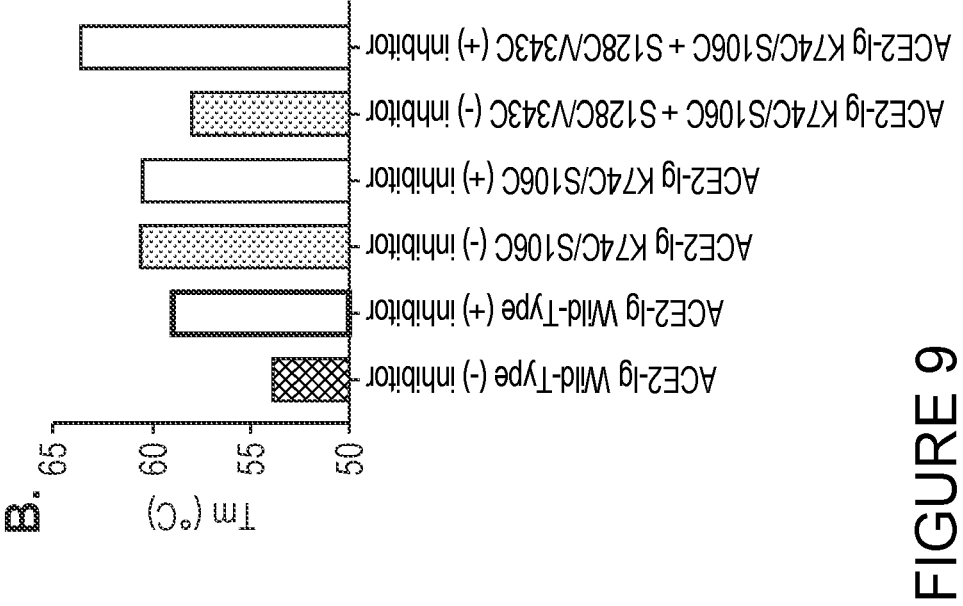
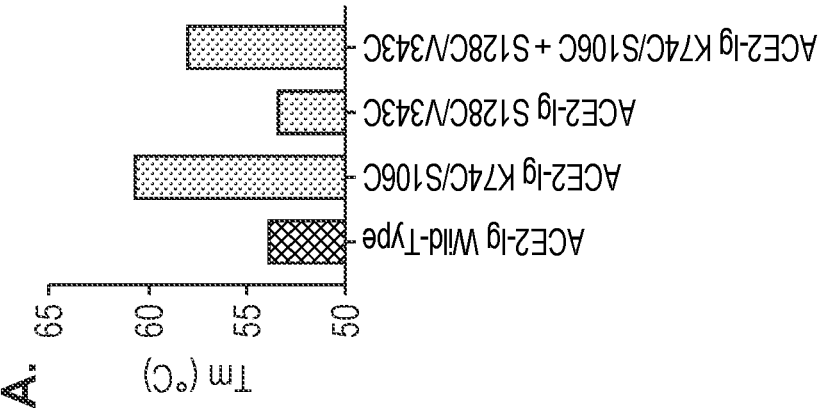
FIGURE 9

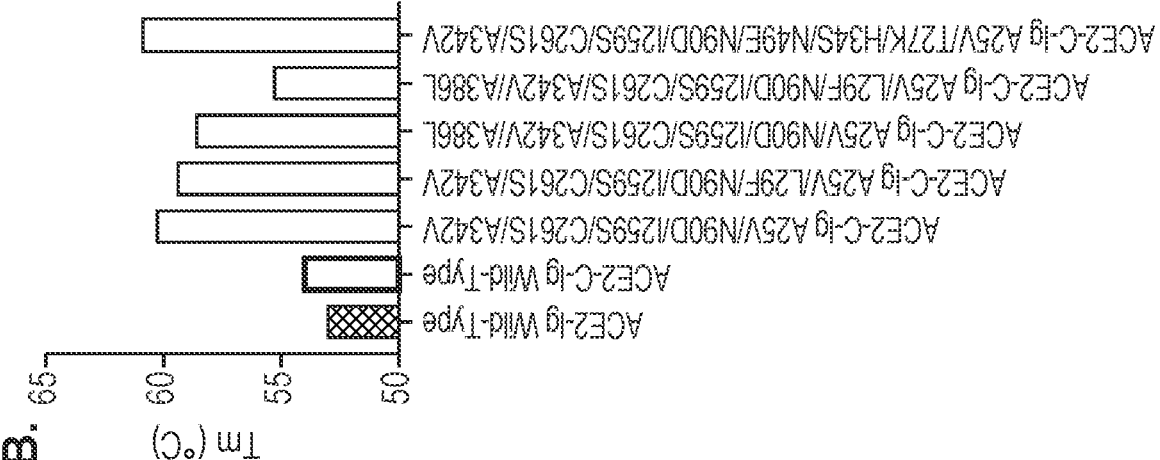
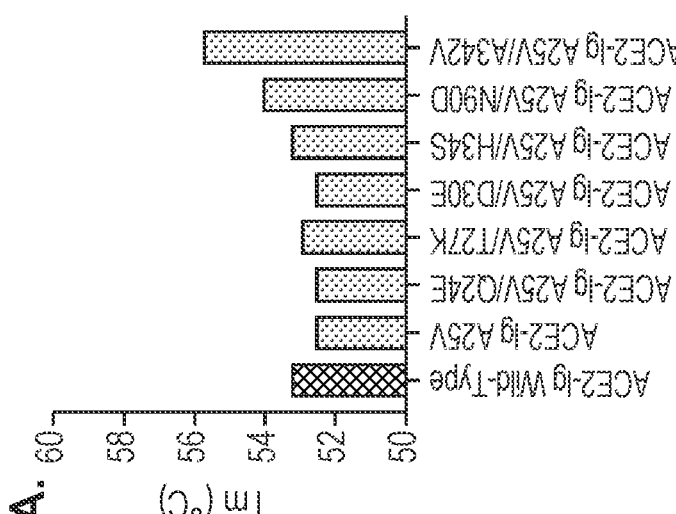
FIGURE 15

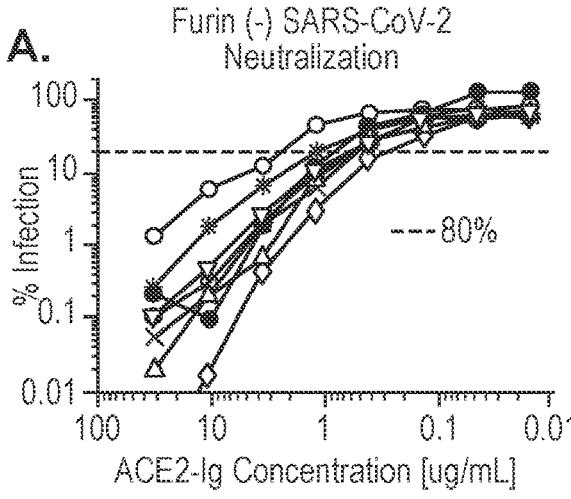

A. Furin (-) SARS-CoV-2 Neutralization

VARIANT [IC80]
- ACE2-Ig Wild-Type [3.1 μg/ml]
- ACE2-Ig A25V [1.0 μg/ml]
- ACE2-Ig A25V/Q24E [1.2 μg/ml]
- ACE2-Ig A25V/T27K [0.66 μg/ml]
- ACE2-Ig A25V/D30E [0.40 μg/ml]
- ACE2-Ig A25V/H34S [0.94 μg/ml]
- ACE2-Ig A25V/N90D [0.33 μg/ml]
- ACE2-Ig A25V/A342V [0.67 μg/ml]

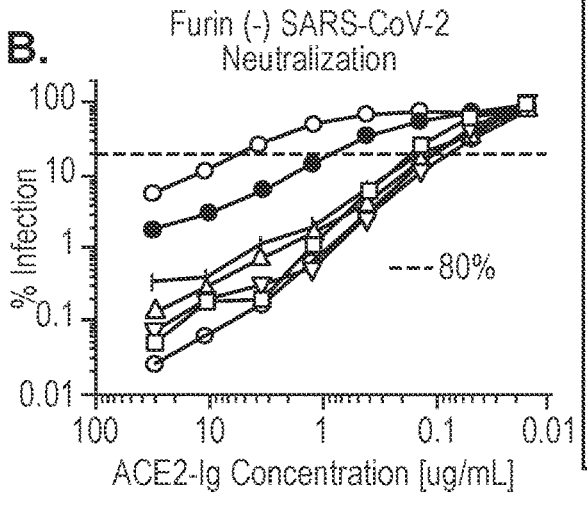

B. Furin (-) SARS-CoV-2 Neutralization

VARIANT [IC80]
- ACE2-Ig Wild-Type [7.7 μg/ml]
- ACE2-C-Ig Wild-Type [1.0 μg/ml]
- ACE2-C-Ig A25V/N90D/A342V [0.15 μg/ml]
- ACE2-C-Ig A25V/T27K/H34S/N49E1N90D [0.22 μg/ml]
- ACE2-C-Ig A25V/L29F/N90D/A342V [0.12 μg/ml]
- ACE2-C-Ig A25V/N90D/A342V/A386L [0.10 μg/ml]
- ACE2-C-Ig A25V/L29F/N90D/A342V/A386L [0.13 μg/ml]

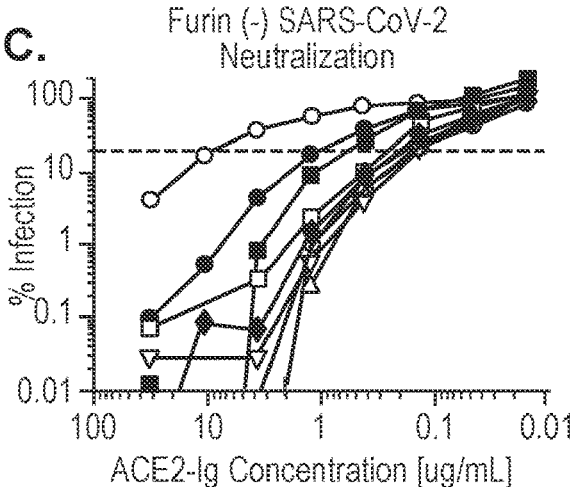

C. Furin (-) SARS-CoV-2 Neutralization

VARIANT [IC80]
- ACE2-Ig Wild-Type [9.7 μg/ml]
- ACE2-C-Ig Wild-Type [1.1 μg/ml]
- ACE2-C-Ig A25V/N90D/A342V [0.22 μg/ml]
- ACE2-C-Ig A25V/T27K/H34S/N49E/N90D [0.34 μg/ml]
- ACE2-C-Ig A25V/L29F/N90D/A342V [0.21 μg/ml]
- ACE2-C-Ig A25V/N90D/A342V/A386L [0.13 μg/ml]
- ACE2-C-Ig A25V/L29F/N90D/A342V/A386L [0.20 μg/ml]
- ACE2-C-Ig A25V/L29F/N90D/A342V/L351F/A386L [0.29 μg/ml]
- ACE2-C-Ig A25V/T27K/L29F/H34S/N49E/N90D/A342V/L351F/A386L [0.75 μg/ml]

B.
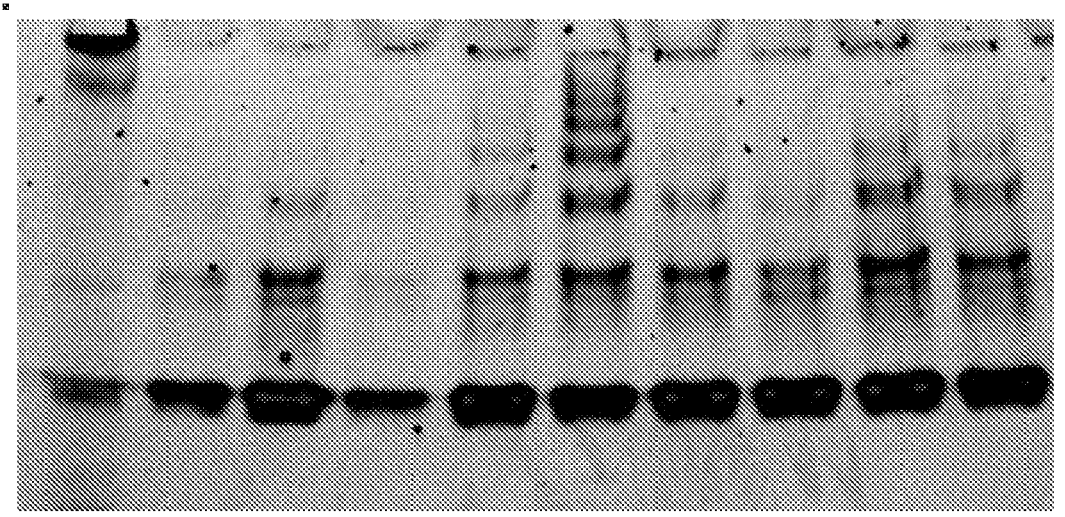
|   |   |   |   |   |   |   |   |   |   |
|---|---|---|---|---|---|---|---|---|---|
| * | A714C | * | V647I V700L A714C | V647I V670L A714C | V647L A714C | I622L A714C | I622L I679L V647I A714C | I622L I679L V647I V670I A714C |
C.
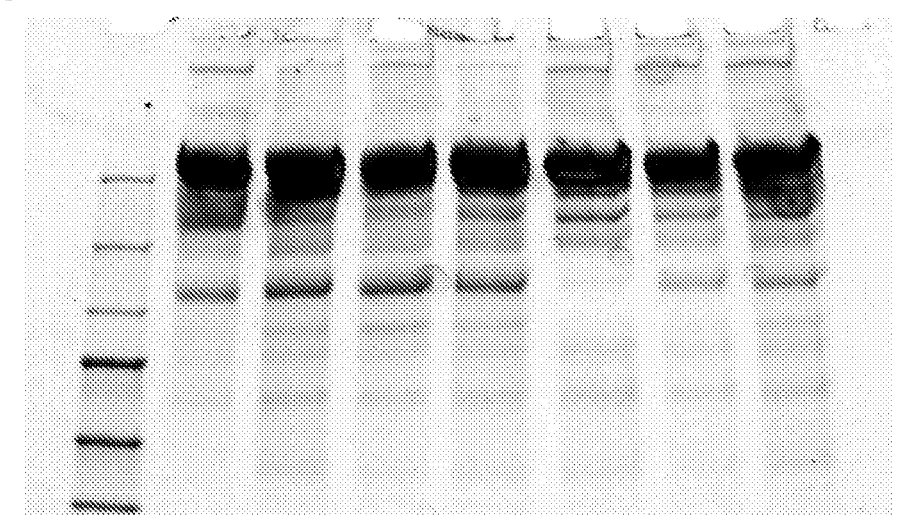
A714C  V647I V700L A714C  V647I V670L A714C  V647L A714C  I622L A714C  I622L I679L V647I A714C  I622L I679L V647I V670I A714C
FIGURE 17 (CONTINUED)

D.
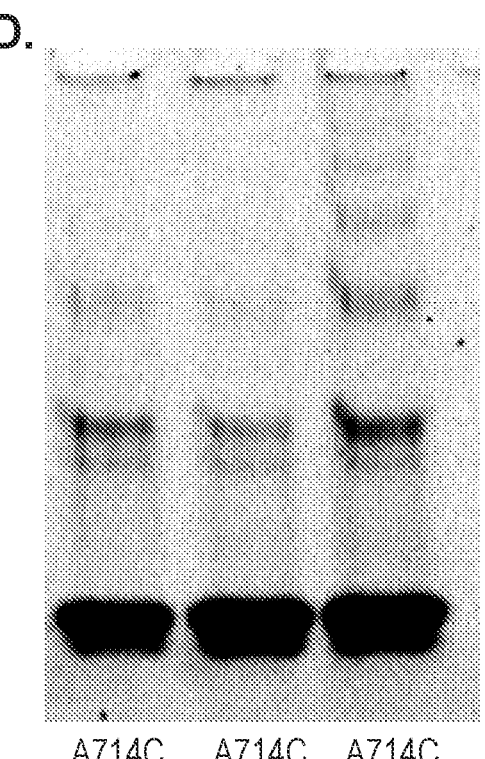
A714C    A714C    A714C
         V620I    V647I
         V647I    V700L
E.
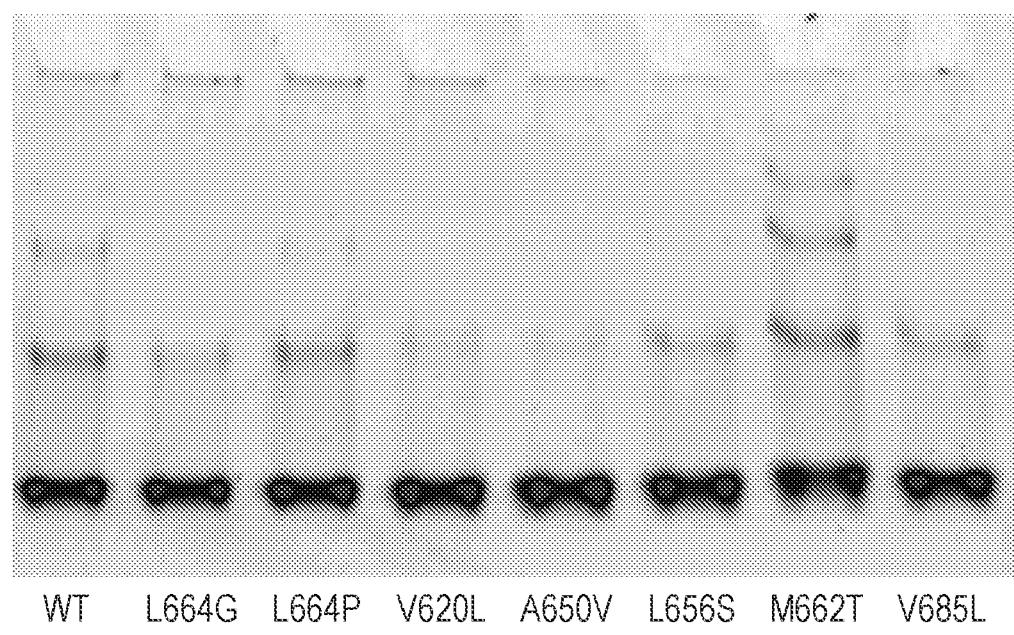
WT    L664G    L664P    V620L    A650V    L656S    M662T    V685L
FIGURE 17 (CONTINUED)

Expected Amino Acid Sequence
DNA                          ------------CACCTGGAGACACATCCACACTGTTTGA------CCTCCA
Cryptic splicing isoform 1   NNNGGNCGNNCTCGGATCNNNCTAGTAACG-GCCGCCAGTGTGCTGGAATTCGCCCTTCCA Expected Amino Acid Sequence
DNA                          TAGCAGAGACACCAGGACCAATCCAGCCTCAAGACAGATTCAGGAACTGAAAAACCAGAAAG
Cryptic splicing isoform 1   TAGCAGAGACACCANGNNNNNTCCAGCCTCAAGACAGATTCAGGAACTGAAAAACCAGAAAG Expected Amino Acid Sequence
DNA                          TTAACAGGTAAGTTTAAAGCTCAGGGCAAGACTGGGCCTTTGCCTGGGTCTCGGTGGTGGT
Cryptic splicing isoform 1   TTAA------------

Expected Amino Acid Sequence
DNA                          GCAAATCAAAGAACTGCTCCTCACATTTTTTCCTTTTCTTCCAGGCCTGTAAGGAAGTG
Cryptic splicing isoform 1   ------------CAGGCCTGTAAGGAAGTG Expected Amino Acid Sequence                                         M   P   M   G   S
DNA                          TTACTTCTACTCTAAAAGCTGAGGAATTGTAGAGCTAGCAGCCACCATGCCTATGGGCTC
Cryptic splicing isoform 1   TTACTTCTACTCTAAAAGCTGAGGAATTGTAGAGCTAGCAGCCACCATGCCTATGGGCTC Expected Amino Acid Sequence  L   Q   P   L   A   T   L   Y   L   L   G   M   L   V   A   S   V   L   A   Q
DNA                          ACTACAGCCATTGGCCACCCTGTATCTCCTGGAATGCTGGTTGCCAGTGTGCTGGCCCA
Cryptic splicing isoform 1   ACTACAGCCATTGGCCACCCTGTATCTCCTGGGAATGCTGGTTGCCAGTGTGCTGGCCCA Expected Amino Acid Sequence  S   I   E   E   Q   V
DNA                          GTCCACCATTGAGGAACAGGTCAAGACATTCCTGGACAAGTTTAACCACGAGCCGAAGA
Cryptic splicing isoform 1   GTCCACCATTGAGGAACAG------------

FIGURE 20

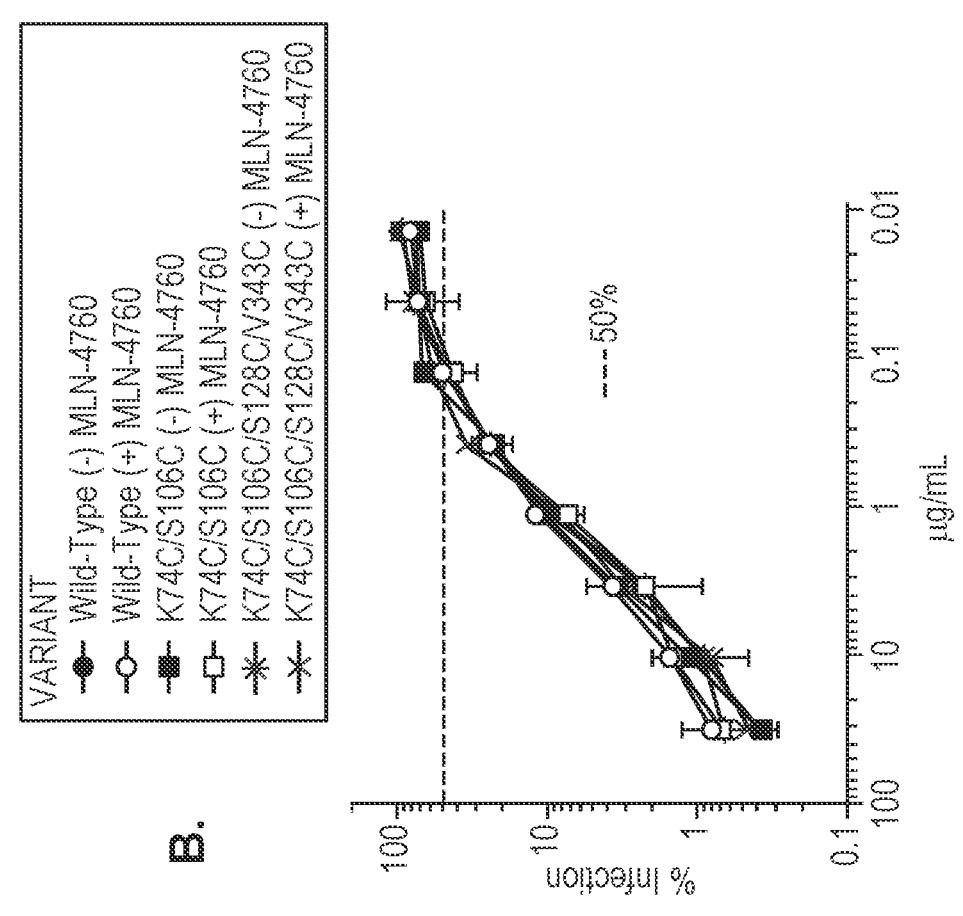
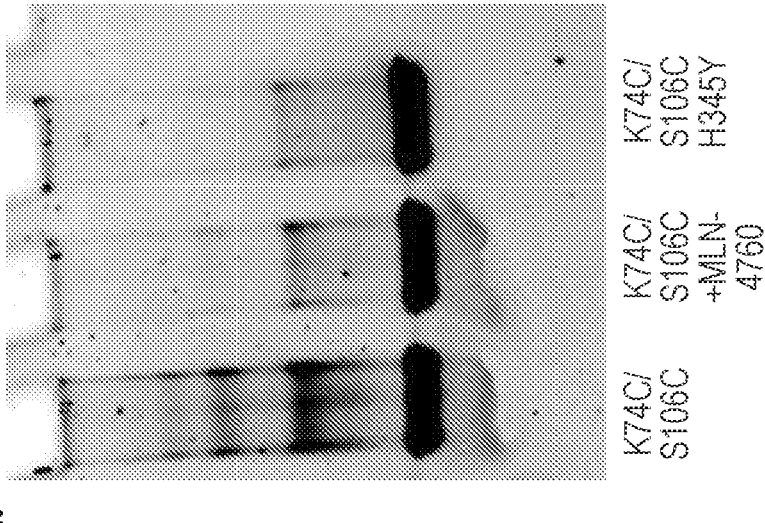
FIGURE 22

A.
B.
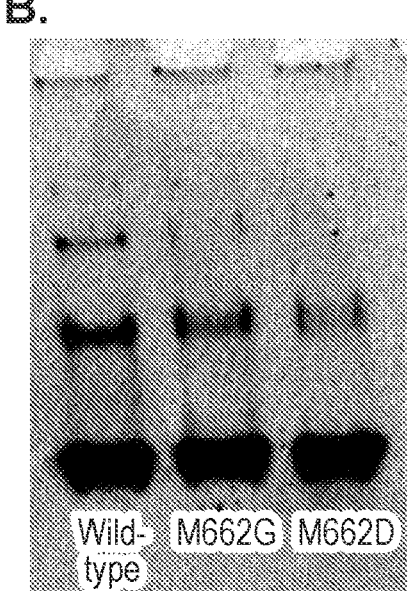
C.
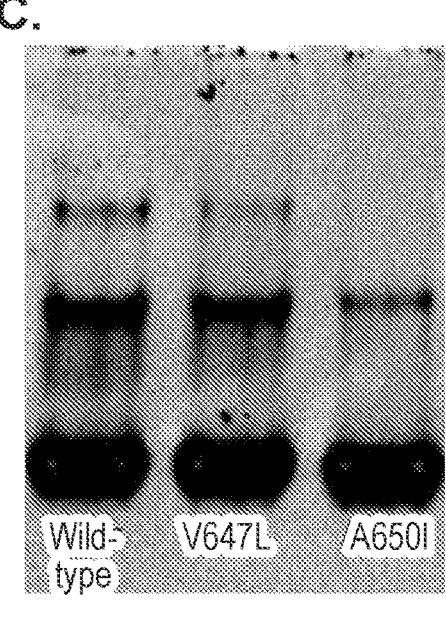
D.
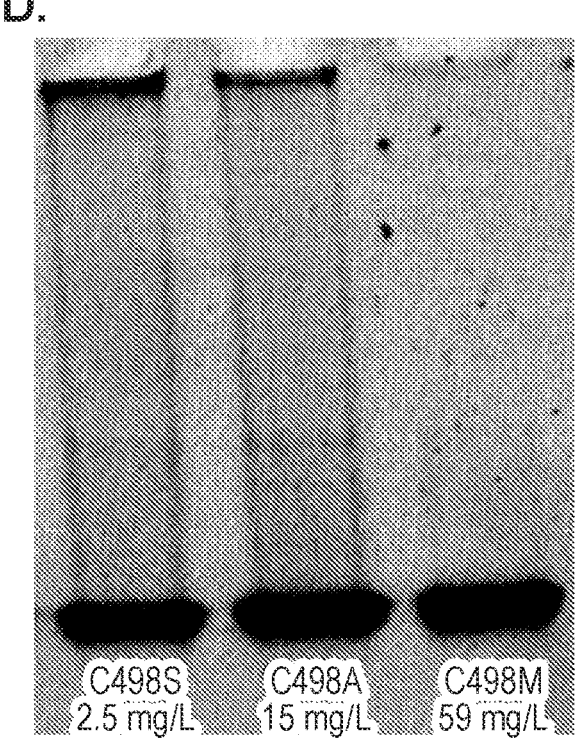
FIGURE 23

ACE2 MUTEINS AND METHODS OF USING THE SAME

CROSS REFERENCE TO RELATED APPLICATIONS

This application is a § 371 National Stage of International (PCT) Patent Application No. PCT/US2021/033454, filed May 20, 2021, which claims the benefit of and priority to U.S. Provisional Patent Application No. 63/027,884, filed May 20, 2020 and U.S. Provisional Patent Application No. 63,052,402, filed Jul. 15, 2020, the disclosure of each of which is hereby incorporated by reference in its entirety.

GOVERNMENT LICENSE RIGHTS

This invention was made with government support under grant numbers R44AI134269 and R44AI145491 awarded by the National Institutes of Health. The government has certain rights in the invention.

FIELD OF THE INVENTION

The invention relates generally to proteins including ACE2 and their use in the treatment of coronavirus infection.

BACKGROUND

Angiotensin-converting enzyme-2 (ACE2) is a functional receptor for severe acute respiratory syndrome (SARS) coronaviruses and human coronavirus NL63. During the SARS-CoV epidemic of 2002-2005, ACE2 was found to be a receptor for SARS-CoV (i.e., SARS-CoV-1) (Li et al., (2003) NATURE 426(6965):450-4). ACE2 also is the receptor for SARS-CoV-2 (Zhou et al., (2020) NATURE 579(7798): 270-273). In addition, ACE2 is used as a receptor by the human coronavirus NL63 (HCoV-NL63) (Hofmann et al., (2005) PROC NATL ACAD SCI USA 102(22):7988-93). An immunoadhesin generated by fusing ACE2 to the Fc of an IgG1 antibody was reported to neutralize SARS-CoV infection (Moore et al. (2004) J VIROL. 78(19):10628-35). There is currently a worldwide public health emergency caused by the SARS-CoV-2 pandemic, with no approved therapies in the United States for treating SARS-CoV-2 infection.

SUMMARY OF THE INVENTION

The invention is based, in part, on the discovery of ACE2 mutant proteins (muteins) having greater stability and/or activity than ACE2 proteins based on naturally-occurring human ACE2 that can be used, for example, for treating SARS-CoV-2 infection. In certain embodiments, the disclosure relates to ACE2 muteins comprising substitutions of amino acids in the hydrophobic interior of ACE2. For example, ACE2 muteins can include substitutions near where ACE2 contacts the receptor binding domain (RBD) of SARS coronavirus S proteins (i.e., the region from S19-S106 and P336-M360 of SEQ ID NO: 1) to improve binding affinity for the RBD and neutralization of SARS coronaviruses. Specifically, substitutions of buried amino acids in the region from S19-S106 and P336-M360 of wild-type human ACE2 with hydrophobic or aromatic amino acids having more carbon atoms or greater molecular weights than the amino acids being replaced can fill spaces within the hydrophobic interior of the protein, thereby increasing the stability of RBD contacts.

Mutations reducing or eliminating the catalytic activity of ACE2 may be desirable; however, known catalytic mutations also affect the stability of ACE2, making production of such proteins difficult. Accordingly, in certain embodiments, the disclosure provides ACE2 muteins comprising substitutions affecting substrate binding, which can reduce or eliminate catalytic activity of ACE2 without destabilizing the molecule. Similarly, the disclosure provides ACE2 muteins comprising substitutions that reduce substrate accessibility to (e.g., close) the substrate-binding cleft, which can improve stability and pharmacokinetics (PK) while also providing an alternate means of rendering the protein catalytically inactive.

The disclosure also relates to substitutions that stabilize the collectrin domain of ACE2, including substitutions that stabilize the homodimerization interface of the collectrin domain, which resulted in enhanced virus neutralization. The collectrin domain of ACE2 is generally defined as amino acids 616-740 of human ACE2 (SEQ ID NO: 1). In certain embodiments, a mutein can comprise a collectrin domain fragment corresponding to amino acids 616-723 or 617-723 of human ACE2 (SEQ ID NO: 1).

Accordingly in one aspect, the disclosure relates to a human angiotensin-converting enzyme 2 (ACE2) mutein, wherein the human ACE2 mutein comprises an amino acid sequence at least 80% (e.g., at least 85%, at least 90%, at least 95%, at least 96%, at least 97%, at least 98%, at least 99%, at least 99.5%, or at least 99.8%) identical to amino acids 19-615 of wild-type human ACE2 (SEQ ID NO: 1) and comprises (a) an ACE2 collectrin domain (amino acids 616-723) of wild-type human ACE2 (SEQ ID NO: 1) comprising (i) one or more substitutions of a buried amino acid in the collectrin domain by a hydrophobic or aromatic amino acid having more carbon atoms or a greater molecular weight than the amino acid that is replaced and/or (ii) one or more substitutions of an exposed or a partially-exposed hydrophobic amino acid by an amino acid having fewer carbon atoms or a lower molecular weight than the amino acid that is replaced, and/or (iii) one or more substitutions of an exposed or a partially-exposed hydrophobic amino acid by a hydrophilic amino acid; or (b) one or more substitutions that reduce substrate accessibility to (e.g., close) the substrate-binding cleft; wherein said mutein is not identical to a wild-type ACE2 of a non-human animal.

In certain embodiments, the ACE2 mutein comprises (a) one or more substitutions of a buried amino acid or a partially-buried serine in wild-type human ACE2 (SEQ ID NO: 1) by a threonine, hydrophobic amino acid, or aromatic amino acid having more carbon atoms or a greater molecular weight than the amino acid that is replaced; and/or (b) one or more substitutions of an exposed or a partially-exposed alanine, valine, proline, isoleucine, leucine, methionine, or phenylalanine in wild-type human ACE2 (SEQ ID NO: 1) by an amino acid having fewer carbon atoms or a lower molecular weight than the amino acid that is replaced.

In certain embodiments, the ACE2 mutein comprises at least one substitution of a cysteine amino acid to a non-cysteine amino acid or at least one substitution of a non-cysteine amino acid to a cysteine amino acid. In certain embodiments, the ACE2 mutein comprises two or more substitutions of a cysteine amino acid to a non-cysteine amino acid or a non-cysteine amino acid to a cysteine amino acid. In certain embodiments, the ACE2 mutein comprises the substitutions S43C and G66C. In certain embodiments, the ACE2 mutein comprises a substitution at a position corresponding to C261, C498, and/or A714 of wild-type human ACE2 (SEQ ID NO: 1).

In certain embodiments, one of said cysteine amino acids is disposed on one side of the angiotensin II substrate-binding cleft of the ACE2 mutein and the other one of said cysteine amino acids is disposed on the opposite side of the cleft, wherein said cysteine amino acid substitutions optionally form a disulfide bond. In certain embodiments, the ACE2 mutein comprises the substitutions K74C and S106C, and/or S128C and V343C. In certain embodiments, the ACE2 mutein comprises at least one substitution at position H345 or F504. In certain embodiments, the ACE2 mutein comprises the substitution H345Y.

In certain embodiments, the ACE2 mutein comprises one or more substitutions that substantially inactivate the catalytic activity of the ACE2 mutein, wherein said substitution is not H374N or H378N. In certain embodiments, the ACE2 mutein comprises the amino acid substitutions H374C and G405C, H374C and S409C, or H374C and G405C. In certain embodiments, the ACE2 mutein comprises one or more substitutions at a position corresponding to V620, I622, A650, L656, M662, L664, V685, and I695 of SEQ ID NO: 1. In certain embodiments, the ACE2 mutein comprises one or more of the substitutions V620I, I622L, A650V, A650I, L656S, M662G, M662D, L664G, L664P, V685L, and/or I695T. In certain embodiments, the ACE2 mutein comprises one or more substitutions at a position corresponding to I259, C261, V339, A342, and/or C498 of SEQ ID NO: 1. In certain embodiments, the ACE2 mutein comprises one or more of the substitutions I259T, C261P, V339G, A342V, and/or C498M. In certain embodiments, the ACE2 mutein comprises a substitution at one or more of the positions corresponding to N90, L91, and T92. In certain embodiments, the substitution comprises N90D. In certain embodiments, the ACE2 mutein further comprises the substitution A25V. In certain embodiments, the ACE2 mutein comprises two or more of the substitutions A25V, L29F, D30E, A342V, and A386L.

In another aspect, the disclosure relates to a fusion protein comprising an ACE2 mutein as described herein and an Fc domain. In certain embodiments, the fusion protein does not comprise the amino acid sequence CPAPELL (SEQ ID NO: 2).

In certain embodiments, the ACE2 mutein or fusion protein comprises a signal peptide at the N-terminus of the mutein, wherein the signal peptide comprises (a) amino acids 1-18 of wild-type human ACE2 (SEQ ID NO: 1), wherein one or more amino acid substitutions, insertions, or deletions is optionally present therein; or (b) a non-ACE2 signal peptide sequence; wherein there are no intervening amino acids between the signal peptide and the N-terminal portion of the mutein having at least 80% identity to amino acids 19-615 of wild-type human ACE2.

In another aspect, the disclosure relates to a nucleic acid encoding a human angiotensin-converting enzyme 2 (ACE2) mutein, wherein the human ACE2 mutein comprises an amino acid sequence at least 80% (e.g., at least 85%, at least 90%, at least 95%, at least 96%, at least 97%, at least 98%, at least 99%, at least 99.5%, or at least 99.8%) identical to amino acids 19-615 of wild-type human ACE2 (SEQ ID NO: 1), wherein (a) the ACE2 mutein-coding region or fusion protein-coding region of the nucleic acid comprises two or more exons separated by one or more introns; (b) the nucleic acid comprises two or more introns; (c) said nucleic acid encodes a mutein comprising the substitution A25V, and the base directly 5' of the codon encoding A25V is not a guanine (G); and/or (d) wherein said nucleic acid does not comprise a T or a C in the second nucleotide position and does not comprise an A in the third nucleotide position of the codon encoding T609 in wild-type human ACE2 (SEQ ID NO: 1).

In another aspect, the disclosure relates to a pharmaceutical composition comprising an ACE2 mutein and a small molecule inhibitor of ACE2.

In another aspect, the disclosure relates to a method of manufacturing a protein comprising a sequence at least 80% identical to amino acids 19-615 of wild-type human ACE2 (SEQ ID NO: 1), said method comprising contacting said protein with a small molecule inhibitor of ACE2.

In certain embodiments, the small molecule inhibitor is MLN-4760.

In another aspect, the disclosure relates to a human angiotensin-converting enzyme 2 (ACE2) mutein. The human ACE2 mutein comprises an amino acid sequence at least 80% (e.g., at least 85%, at least 90%, at least 95%, at least 96%, at least 97%, at least 98%, at least 99%, at least 99.5%, or at least 99.8%) identical to amino acids 19-615 and optionally amino acids 616-723 of wild-type human ACE2 (SEQ ID NO: 1) and comprises:

(a) at least one of (including combinations thereof):

(i.) one or more substitutions of a buried amino acid or a partially-buried serine in wild-type human ACE2 (SEQ ID NO: 1) by a threonine, hydrophobic amino acid, or aromatic amino acid having more carbon atoms or a greater molecular weight than the amino acid that is replaced;

(ii.) one or more substitutions of an exposed or a partially-exposed alanine, valine, proline, isoleucine, leucine, methionine, or phenylalanine in wild-type human ACE2 (SEQ ID NO: 1) by an amino acid having fewer carbon atoms or a lower molecular weight than the amino acid that is replaced;

(iii.) at least two cysteine amino acid substitutions, wherein one of said cysteine amino acids is disposed on one side of the angiotensin II substrate-binding cleft of the ACE2 mutein and the other one of said cysteine amino acids is disposed on the opposite side of the cleft, wherein said cysteine amino acid substitutions optionally form a disulfide bond;

(iv.) one or more substitutions and/or deletions at a position corresponding to M249, P258, I259, or F603 of wild-type human ACE2 (SEQ ID NO: 1);

(v.) one or more substitutions that substantially inactivate the catalytic activity of the ACE2 mutein, wherein the substitution is not H374N or H378N; and (vi.) a signal peptide at the N-terminus of the mutein, wherein the signal peptide comprises (A) amino acids 1-18 of wild-type human ACE2 (SEQ ID NO: 1), wherein one or more amino acid substitutions, insertions, or deletions is present therein or (B) a non-ACE2 signal peptide sequence, optionally wherein there are no intervening amino acids between the signal peptide and the N-terminal portion of the mutein having at least 80% identity to amino acids 19-615 of wild-type human ACE2;

or, (b) wherein the ACE2 mutein further comprises a collectrin domain having an amino acid sequence at least 80% (e.g., at least 85%, at least 90%, at least 95%, at least 96%, at least 97%, at least 98%, at least 99%, at least 99.5%, or at least 99.8%) identical to the collectrin domain of wild-type human ACE2 (SEQ ID NO: 1) amino acids 616-723, and comprises at least one of (including combinations thereof):

(i.) one or more cysteine amino acid substitutions between amino acids 616-723 of human ACE2 (SEQ ID NO: 1), wherein said cysteine amino acid substitution optionally forms a disulfide bond; and (ii.) one or more substitutions of a buried amino acid or a partially-buried serine in wild-type human ACE2 (SEQ ID NO: 1) by a threonine, hydrophobic amino acid, or aromatic amino acid having more carbon atoms or a greater molecular weight than the amino acid that is replaced, wherein the buried amino acid or the partially-buried serine is in the collectrin domain of wild-type human ACE2 (SEQ ID NO: 1) amino acids 616-723;

wherein said mutein is not identical to a wild-type ACE2 of a non-human animal.

In certain embodiments, the one or more substitutions, at least two cysteine amino acid substitutions, or the signal peptide increases the thermal stability of the protein relative to human wild type ACE2.

In certain embodiments, the one or more substitutions, at least two cysteine amino acid substitutions, or the signal peptide increases the plasma half-life of the protein relative to human wild type ACE2 in an animal.

In certain embodiments, the one or more substitutions, at least two cysteine amino acid substitutions, or the signal peptide decreases the concentration of the protein needed to neutralize 80% of the infectivity of a virus or pseudovirus comprising the spike (S) protein of SARS-CoV-1 or SARS-CoV-2 relative to human ACE2.

In certain embodiments, the amino acid that is replaced has a fractional accessible surface area (ASA) value of less than 0.1 in the structure of ACE2 having protein data bank (PDB) code 1R42, as set forth in TABLE 4. In certain embodiments, the amino acid that is replaced has a fractional accessible surface area (ASA) value that is greater in the structure of ACE2 having PDB code 1R42 than in the structure of ACE2 having the PDB code 1R4L, as set forth in TABLE 4. In certain embodiments, the amino acid that is replaced has a fractional accessible surface area (ASA) value that is greater in the structure of ACE2 having PDB code 1R42 than in the structure of ACE2 having PDB code 6M17, as set forth in TABLE 4.

In certain embodiments, the ACE2 mutein comprises one or more substitutions of an exposed or a partially-exposed alanine, valine, proline, isoleucine, leucine, methionine, or phenylalanine in wild-type human ACE2 (SEQ ID NO: 1) by an amino acid having fewer carbon atoms or a lower molecular weight than the amino acid that is replaced, and the exposed or a partially-exposed alanine, valine, proline, isoleucine, leucine, methionine, or phenylalanine has a fractional accessible surface area (ASA) value of greater than or equal to 0.5 in the structure of ACE2 having protein data bank (PDB) code 6M17, as set forth in TABLE 4.

In certain embodiments, the ACE2 mutein comprises a single cysteine substitution at a position corresponding to amino acids 616-723 of human ACE2 (SEQ ID NO: 1). In certain embodiments, the ACE2 mutein comprises the amino acid substitution A714C.

In certain embodiments, the one or more substitutions is disposed within the region corresponding to S19-S106 or P336-M360 of human ACE2 (SEQ ID NO: 1). In certain embodiments, the one or more substitutions is at a position corresponding to I21, A25, A36, L73, V93, L97, A99, A342, or V343 of human ACE2 (SEQ ID NO: 1). In certain embodiments, the one or more substitutions comprises a substitution at a position corresponding to A25 or A342. In certain embodiments, the one or more substitutions comprises A25V or A342V. In certain embodiments, the one or more substitutions comprises A342V.

In certain embodiments, the ACE2 mutein further comprises one or more substitutions at positions T27, L29, D30, H34, N49, W69, F72, N90, L91, T92, and A386. In certain embodiments, the substitution comprises T27K, L29F, D30E, H34S, N49E, W69V, F72Y, N90A, N90D, L91P, T92I, or A386L, or a combination of the foregoing. In certain embodiments, the ACE2 mutein comprises one or more of the following combinations of substitutions:

(a) A25V and L29F;

(b) A25V and A386L;

(c) A25V, L29F, and A386L;

(d) A25V, L29F, and a substitution at one or more of the positions corresponding to N90, L91, and T92;

(e) A25V and A386L, and a substitution at one or more of the positions corresponding to N90, L91, and T92;

(f) A25V, L29F, and A386L, and a substitution at one or more of the positions corresponding to N90, L91, and T92;

(g) A25V, L29F, and D30E;

(h) A25V, D30E, and A386L;

(i) A25V, L29F, D30E, and A386L;

(j) A25V, L29F, D30E, and a substitution at one or more of the positions corresponding to N90, L91, and T92;

(k) A25V, D30E and A386L, and a substitution at one or more of the positions corresponding to N90, L91, and T92; and (l) A25V, L29F, D30E, and A386L, and a substitution at one or more of the positions corresponding to N90, L91, and T92.

In certain embodiments, the ACE2 mutein comprises two or more of the substitutions A25V, L29F, D30E, A342V, and A386L. In certain embodiments, the ACE2 mutein further comprises a substitution at one or more of the positions corresponding to N90, L91, and T92.

In certain embodiments, the one or more substitutions is at a position having a different amino acid in a non-human mammal ACE2 as compared to human ACE2 (SEQ ID NO: 1). In certain embodiments, the one or more substitutions replaces the amino acid present at that position in human ACE2 (SEQ ID NO: 1) with the amino acid present at the corresponding position in a non-human mammal ACE2. In certain embodiments, the one or more substitutions is at a position having a different amino acid in a non-human primate ACE2 as compared to human ACE2 (SEQ ID NO: 1). In certain embodiments, the one or more substitutions replaces the amino acid present at the corresponding position in human ACE2 (SEQ ID NO: 1) with the amino acid present at that position in a non-human primate ACE2.

In certain embodiments, the one or more substitutions comprises a substitution at a position corresponding to I21, E22, A25, N33, A36, F40, S44, S47, N51, G66, L73, Q76, A80, I88, L91, V93, Q96, L97, Q98, A99, Q101, V132, L144, A164, S167, V172, L176, A191, N194, V209, V212, V226, T229, H241, L248, A251, C261, R273, T282, V293, A311, F315, V318, S331, L333, A342, V343, A443, L351, T362, A372, H373, G377, Q380, D382, A386, H373, N397, V404, S411, A412, T414, I421, G422, L423, L440, A443, V447, G448, T449, L450, T454, E457, R460, V463, M474, G486, V487, V488, V491, H493, C498, A501, V506, T517, T519, Q526, L558, G561, A569, or V573 of wild-type human ACE2 (SEQ ID NO: 1).

In certain embodiments, the one or more substitutions comprises a substitution at a position corresponding to I21, E22, A36, F40, S44, S47, N51, G66, L73, A80, I88, L97, Q98, A99, Q101, V132, L144, A164, S167, V172, L176, A191, N194, V209, V212, V226, T229, H241, L248, A251, I259, C261, R273, T282, V293, A311, F315, V318, S331, L333, A342, V343, A443, L351, T362, A372, H373, Q377, Q380, D382, A386, H373, N397, V404, S411, A412, T414, I421, G422, L423, L440, A443, V447, G448, T449, L450, T454, E457, R460, V463, M474, G486, V487, V488, V491, H493, C498, A501, V506, T517, T519, Q526, L558, G561, A569, and V573 of wild-type human ACE2 (SEQ ID NO: 1).

In certain embodiments, the one or more substitutions comprises a substitution selected from I21P, I21F, I21W, E22L, E22I, E22F, E22Y, A25V, N33L, A36V, F40Y, S44V, S44I, S44M, S47T, N51V, G66A, L73F, L73Y, Q76L, A80V, A80I, I88F, L91P, V93I, V93L, Q96L, L97F, Q98L, A99V, A99L, A99F, A99Y, Q101L, Q101M, V132I, V132L, L144F, A164, S167T, V172, L 176M, A191V, N194L, N194L, V209L, V209L, V209M, V212I, V212L, V212F, V212Y, V226L, T229V, H241F, L248M, A251V, I259S, I259T, C261V, C261L, C261M, C261P, R273F, T282M, T282V, T282I, T282L, V293I, V293L, A311V, F315Y, V318I, V318L, S331T, S331V, S331I, L333F, A342V, V343I, L351F, T362V, T362I, T362L, A372V, H373F, H373Y, G377A, Q380L, Q380M, D382L, A386, H373, N397L, V404L, V404L, S411T, S411V, A412, T414V, I421M, G422A, L423F, L440F, A443V, V447I, V447L, G448A, G448V, T449V, L450M, T454V, E457I, R460L, R460M, V463L, V463F, M474I, G486A, V487I, V488M, V491I, V491L, V491M, H493F, C498V, C598I, C598M, A501V, V506I, T517V, T517I, T517L, T517M, T519V, T519I, T519L, T519M, Q526H, Q526L, Q526M, Q526F, L558M, G561A, A569L, V573M, and V573M.

In certain embodiments, the one or more substitutions comprises a substitution selected from I21P, I21F, I21W, E22L, E22I, E22F, E22Y, A25V, N33L, A36V, F40Y, S44V, S44I, S44M, S47T, N51V, G66A, L73F, L73Y, A80V, A80I, I88F, V93I, V93L, Q96L, L97F, Q98L, A99V, A99L, A99F, A99Y, Q101L, Q101M, V132L, V132L, L144F, A164, S167T, V172, L 176M, A191V, N194I, N194L, V209I, V209L, V209M, V212I, V212L, V212F, V212Y, V226L, T229V, H241F, L248M, A251V, I259S, I259T, C261V, C261I, C261M, C261P, R273F, T282M, T282V, T282I, T282L, V293I, V293L, A311V, F315Y, V318I, V318L, S331T, S331V, S331I, L333F, A342V, V343I, L351F, T362V, T362I, T362L, A372V, H373F, H373Y, G377A, Q380I, Q380M, D382L, A386, H373, N397L, V404I, V404L, S411T, S411V, A412, T414V, I421M, G422A, L423F, L440F, A443V, V447I, V447L, G448A, G448V, T449V, L450M, T454V, E457I, R460L, R460M, V463L, V463F, M474I, G486A, V487I, V488M, V491I, V491L, V491M, H493F, C498V, C598I, C598M, A501V, V506I, T517V, T517I, T517L, T517M, T519V, T519L, T519L, T519M, Q526H, Q526L, Q526M, Q526F, L558M, G561A, A569L, V573M, and V573M.

In certain embodiments, the one or more substitutions comprises a substitution at a position corresponding to I21, A25, A36, F40, S44, G66, L73, A80, I88, L91, V93, A99, A164, S167, V172, L176, N194, V209, V212, T229, H241, L248, A251, C261, R273, F315, V318, A342, V343, L351, A386, V404, A412, I421, L440, L450, M474, V488, V491, L558, or V573 of wild-type human ACE2 (SEQ ID NO: 1).

In certain embodiments, the one or more substitutions comprises a substitution at a position corresponding to I21, A25, A36, F40, S44, L73, A80, V93, A99, A164, V172, V212, A251, V318, A342, V343, A412, V491, L558, or V573 of wild-type human ACE2 (SEQ ID NO: 1).

In certain embodiments, the one or more substitutions comprises a substitution at a position corresponding to E22, N33, S44, S47, N51, Q76, Q96, Q98, Q101, S167, N194, T229, H241, C261, R273, T282, S331, T362, H373, Q380, D382, N397, S411, T414, T449, T454, E457, R460, H493, C498, T517, T519, or Q526 of wild-type human ACE2 (SEQ ID NO: 1).

In certain embodiments, the one or more substitutions comprises a substitution at a position corresponding to A25, A36, A80, L97, V132, L144, A164, A191, V226, V293, A311, V318, L333, A372, G377, V404, G422, L423, A443, V447, G448, V463, G486, V487, A501, G561, or A569 of wild-type human ACE2 (SEQ ID NO: 1).

In certain embodiments, said ACE2 mutein comprises at least two cysteine substitution, wherein said cysteine substitutions form a disulfide bond, increase the thermal stability of the protein, or increase the plasma half-life of the protein in an animal. In certain embodiments, the ACE2 mutein comprises the cysteine substitutions K74C and S106C, or S128C and V343C. In certain embodiments, said ACE2 mutein does not contain a cysteine amino acid at position 344 or 361.

In certain embodiments, said ACE2 mutein comprises at least one substitution at position H345 or F504. In certain embodiments, said ACE2 mutein comprises the substitution H345Y.

In certain embodiments, said ACE2 mutein comprises a substitution at the position corresponding to S128. In certain embodiments, said ACE2 mutein comprises the substitution S128T, S128V, S128I, S128L, or S128F.

In certain embodiments, said ACE2 mutein comprises at least one substitution or deletion at a position corresponding to C133, N134, P135, D136, N137, P138, Q139, E140, C141, or W163.

In another embodiment, the disclosure relates to a fusion protein comprising an ACE2 mutein as described herein. In certain embodiments, the fusion protein comprises an Fc domain.

In certain embodiments, the mutein or fusion protein (i) does not comprise a histidine at amino acid 374 of wild-type human ACE2 (SEQ ID NO: 1), and/or (ii) does not comprise a histidine at amino acid 378 of wild-type human ACE2 (SEQ ID NO: 1).

In certain embodiments, the mutein or fusion protein comprises two cysteine amino acid substitutions, wherein at least one of the cysteine amino acid substitutions is located at a position corresponding to H374 or H378 of human ACE2 (SEQ ID NO: 1). In certain embodiments, the mutein or fusion protein comprises the amino acid substitutions H374C and G405C, H374C and S409C, or H374C and G405C.

In certain embodiments, the mutein or fusion protein comprises an amino acid substitution at the position corresponding to R273, H345, P346, T371, E475, E402, H505, or Y515 of human ACE2 (SEQ ID NO: 1).

In another aspect, the disclosure relates to a protein comprising (i) a human angiotensin-converting enzyme 2 (ACE2) mutein, wherein the human ACE2 mutein comprises an amino acid sequence at least 80% (e.g., at least 85%, at least 90%, at least 95%, at least 96%, at least 97%, at least 98%, at least 99%, at least 99.5%, or at least 99.8%) identical to amino acids 19-615 of wild-type human ACE2 (SEQ ID NO: 1), and (ii) an antibody Fc domain comprising a hinge comprising at least one cysteine, wherein:

(a) said hinge does not comprise the amino acid sequence CPAPELL (SEQ ID NO: 2), (b) the amino acid sequence of human ACE2 (SEQ ID NO: 1) or the amino acid sequence of the collectrin domain of human ACE2 and the amino acid sequence of the hinge are joined at an amino acid that is the same in each sequence to form a junction;

(c) six to twenty-five amino acids disposed between the N-terminal cysteine of said hinge and amino acid 613 based on the consecutive numbering of amino acid positions in the ACE2 mutein in SEQ ID NO: 1; or ten to thirty amino acids disposed between the N-terminal cysteine of said hinge and amino acid 725 based on the consecutive numbering of amino acid positions in the collectrin domain of wild-type human ACE2;

(d) none of the six amino acids immediately preceding, in an N-to-C direction, the N-terminal cysteine of said hinge are leucine, isoleucine, valine, methionine, proline, phenylalanine, or tryptophan;

(e) the hinge is linked to the ACE2 mutein by an amino acid sequence comprising at least one of the potential O-linked glycosylation sites: SS, ST, TS, TT, or at least one of the potential N-linked glycosylation sites: NXS, NXT, NNSS (SEQ ID NO: 16), NNST (SEQ ID NO: 17), NNTS (SEQ ID NO: 18), or NNTT (SEQ ID NO: 19), wherein X is any amino acid.

In certain embodiments, the protein comprises the sequence CPAPPV (SEQ ID NO: 9), CPAPEFL, (SEQ ID NO: 10) or CPAPEAA (SEQ ID NO: 11). In certain embodiments, the hinge comprises an IgA hinge sequence, and the antibody Fc domain comprises an IgG1 sequence (SEQ ID NO: 20), an IgG2 sequence (SEQ ID NO: 21), and IgG3 sequence (SEQ ID NO: 22), or an IgG4 sequence (SEQ ID NO. 23). In certain embodiments, the hinge is glycosylated.

In certain embodiments, the mutein, fusion protein, or protein comprises a collectrin domain having an amino acid sequence at least 80% (e.g., at least 85%, at least 90%, at least 95%, at least 96%, at least 97%, at least 98%, at least 99%, at least 99.5%, or at least 99.8%) identical to the collectrin domain of wild-type human ACE2 (amino acids 616-723 of SEQ ID NO: 1).

In certain embodiments, the mutein, fusion protein, or protein comprises an amino acid substitution at a position corresponding to Y613, S645, S646, R671, A673, V691, S692, A714 of the collectrin domain of wild-type human ACE2 (amino acids 616-723 of SEQ ID NO: 1). In certain embodiments, the mutein, fusion protein, or protein comprises the amino acid substitution A714C.

In certain embodiments, the mutein, fusion protein, or protein comprises at least one substitution at a position corresponding to I618, V620, I622, A632, L642, S645, S646, V647, A650, V670, R671, V672, A673, L675, I679, V685, V691, V700, I704, M706, S707, I711, A714, S721, and/or F724 of the collectrin domain of wild-type human ACE2 (amino acids 616-723 of SEQ ID NO: 1). In certain embodiments, the mutein, fusion protein, or protein comprises at least one of the amino acid substitutions I618L, V620I, V620L, I622L, A632P, L642F, S645T, S645V, S645I, S646T, S645V, S646I, S646M, S646L, S646F, V647I, V647L, A650V, A650I, V670I, V670L, R671L, V672L, V672L, A673L, A673F, L675I, L675F, I679L, V685I, V685L, V691L, V691I, V691M, V700I, V700L, I704L, M706F, S707T, I711L, A714V, A714I, S721T, and F724W.

In certain embodiments, the mutein, fusion protein, or protein comprises at least one substitution at a position corresponding to P289, A301, V339, A387, F655, L656, M622, L664, P677, and I695 of wild-type human ACE2 (SEQ ID NO: 1). In certain embodiments, the mutein, fusion protein, or protein comprises at least one of the amino acid substitutions P289G, A301G, V339G, V339D, A387G, F655Y, L656S, M622T, L664P, P677G, and I695T.

In certain embodiments, the mutein, fusion protein, or protein comprises at least one amino acid substitution at a position corresponding to E634, N638, E639, Y641, L642, S645, S646, Y649, R652, K657, S709, R710, D713, A714, and/or R716 of human ACE2 (SEQ ID NO: 1).

In another embodiment, the disclosure relates to a pharmaceutical composition comprising a mutein, fusion protein, or protein as described herein.

In another embodiment, the disclosure relates to a nucleic acid encoding a mutein, fusion protein, or protein as described herein. In certain embodiments, the nucleic acid encodes a mutein comprising the substitution A25V, and the base directly 5' of the codon encoding A25V is not a guanine (G). In certain embodiments, the nucleic acid does not comprise a T or a C in the second nucleotide position and does not comprise an A in the third nucleotide position of the codon encoding T609. In certain embodiments, the nucleic acid comprises at least two exons separated by at least one intron. In certain embodiments, the nucleic acid comprises two or more introns.

In another aspect, the disclosure relates to a method of manufacturing a protein comprising a sequence at least 80% identical to amino acids 19-615 of wild-type human ACE2 (SEQ ID NO: 1), said method comprising contacting said protein with a small molecule inhibitor of ACE2. In one embodiment, the disclosure relates to a method of manufacturing a protein comprising a mutein, fusion protein, or protein as described herein, said method comprising contacting said mutein, fusion protein, or protein as described herein with a small molecule inhibitor of ACE2. In certain embodiments, the small molecule inhibitor is MLN-4760.

These and other aspects and features of the invention are described in the following detailed description and claims.

BRIEF DESCRIPTION OF THE DRAWINGS

In order to understand the invention and to demonstrate how it may be carried out in practice, embodiments are now described, by way of non-limiting example only, with reference to the accompanying drawings in which:

FIGS. 1A-B provides schematic depictions ACE2 fusion proteins. FIG. 1A provides a protein comprising an ACE2 protein fragment, an antibody hinge and an Fc region in an N- to C-terminal direction. ACE2 is an enzyme with a large cleft that binds its substrate, angiotensin II (AngII). Proteins comprising ACE2 optionally can include a collectrin domain (FIG. 1B). The collectrin domain corresponds approximately to amino acids 616-740 of SEQ ID NO: 1. One notable feature of the collectrin domain is that it contains a homodimerization interface.

FIGS. 2A-O is an alignment of human ACE2 with non-human primate ACE2 sequences. Sequence identifiers for the sequences shown are as follows: Human (SEQ ID NO: 1), Chimpanzee (SEQ ID NO: 69), Bonobo (SEQ ID NO: 70), Gorilla (SEQ ID NO: 71), Northern_white-cheeked_gibbon (SEQ ID NO: 72), Sumatran_orangutan (SEQ ID NO: 73), Red_colobus_monkey (SEQ ID NO: 74), Golden_snub-nosed_monkey (SEQ ID NO: 75), Black_snub-nosed_monkey (SEQ ID NO: 76), African_green_monkey (SEQ ID NO: 77), Sooty_mangabey (SEQ ID NO: 78), Mandrill (SEQ ID NO: 79), Rhesus_macaque (SEQ ID NO: 80), Pig-tailed_macaque (nemestrina) (SEQ ID NO: 81), Crab-eating_macaque (fascicularis) (SEQ ID NO: 82), Gelada_baboon (SEQ ID NO: 83), Olive_baboon (SEQ ID NO: 84), white-tufted-ear_marmoset (SEQ ID NO: 85), Bolivian_s-quirrel_monkey (SEQ ID NO: 86), Ma's_night_monkey (SEQ ID NO: 87), White-faced_capuchin (SEQ ID NO: 88), Tufted_capuchin (SEQ ID NO: 89), Tarsier (SEQ ID NO: 90), Galago (SEQ ID NO: 91), gray_mouse_lemur (SEQ ID NO: 92), Coquerel's_sifaka (SEQ ID NO: 93).

FIGS. 3A-O is an alignment of human ACE2 with non-primate mammal ACE2 sequences. Sequence identifiers for the sequences shown are as follows: Human (SEQ ID NO: 1), Wombat (SEQ ID NO: 94), Common_vampire_bat (SEQ ID NO: 95), Mus_musculus (SEQ ID NO: 96), Norway_rat (SEQ ID NO: 97), Big_brown_bat (SEQ ID NO: 98), Little_brown_bat (SEQ ID NO: 99), Black_flying_fox (SEQ ID NO: 100), Large_flying_fox (SEQ ID NO: 101), Rabbit (SEQ ID NO: 102), Pig (SEQ ID NO: 103), Cow (SEQ ID NO: 104), Sheep (SEQ ID NO: 105), Yak (SEQ ID NO: 106), Sperm_whale (SEQ ID NO: 107), Narwhal (SEQ ID NO: 108), Orca (SEQ ID NO: 109), Dog (SEQ ID NO: 110), Ferret (SEQ ID NO: 111), Panda (SEQ ID NO: 112), California_sea_lion (SEQ ID NO: 113), Monk_seal (SEQ ID NO: 114), Meerkat (SEQ ID NO: 115), Masked_palm_civet (SEQ ID NO: 116), Puma (SEQ ID NO: 117), Cat (SEQ ID NO: 118), Lynx (SEQ ID NO: 119), Pangolin (SEQ ID NO: 120), Horse (SEQ ID NO: 121).

FIGS. 4A-E is an analysis of changes in fractional accessible surface area (ASA) among different structures of ACE2. The relationship between fractional accessible surface area (ASA) and visual assessment of the exposed, partially-exposed, or buried disposition of an amino acid side chain was evaluated (FIG. 4A). The differences in fractional ASA values for each comparison of exposed versus partially-exposed, partially-exposed versus buried, and exposed versus buried were all significant (P<0.0001 for each). The dotted line is drawn at a fractional ASA value of 0.1. Fractional ASA values from buried amino acids in the MLN-4760 inhibitor-bound structure 1 R4L were subtracted from those of the native structure 1R42 and the positive difference (A) shown in FIG. 4B. Fractional ASA values from partially-buried amino acids the MLN-4760 inhibitor-bound structure 1R4L were subtracted from those of the native structure 1R42 and the positive difference shown in FIG. 4C. Fractional ASA values from buried amino acids in the SARS-CoV-2 RBD-bound structure 6M17 containing the collectrin domain were subtracted from those of the native structure 1R42 and the positive difference shown in FIG. 4D. Fractional ASA values from partially-buried amino acids in the SARS-CoV-2 RBD-bound structure 6M17 containing the collectrin domain were subtracted from those of the native structure 1R42 and the positive difference shown in FIG. 4E. A web-based computational tool, named Volume Area Dihedral Angle Reporter (VADAR) (website located at redpoll.pharmacy.ualberta.ca/vadar) (Willard et al., (2003) NUCLEIC ACIDS RES. 31(13):3316-9), was used to calculate the fractional ASA values shown here. The structures used as inputs for VADAR were PDB codes 1R42 for amino acids 19-615 of human ACE2 (SEQ ID NO: 1), and 6M17 for amino acids 616-740 of human ACE2 (SEQ ID NO: 1). As explained in greater depth by Willard et al., and the references therein, ASA values are calculated by dividing the solvent-accessible surface area of the amino acid in the structure by the solvent-accessible surface area of the same amino acid when present in an extended G-X-G tripeptide, where X represents the amino acid.

FIGS. 5A-H provides graphs depicting the results of SARS coronavirus neutralization assays. Several variants of proteins comprising human ACE2 without the collectrin domain and an Fc region ("ACE2-Ig") were evaluated for neutralization of SARS-CoV-1 (FIG. 5A), SARS-CoV-2 (FIG. 5B), and the furin cleavage site (−) form of SARS- CoV-2 (FIG. 5C). The ACE2-Ig variants tested included a wild-type ACE2 control, the space-filling mutations A25V, A25L, A36L, A80V, I88F, L97F, a variant lacking a disulfide loop (C133S/C141S), the catalytically-inactive variant H374N/H378N, and the substrate-binding mutant H505L. Variants without the collectrin domain (ACE2-Ig) and variants with the collectrin domain (ACE2-C-Ig) were compared for neutralization of SARS-CoV-1 (FIG. 5D), SARS-CoV-2 (FIG. 5E), and the furin cleavage site (−) form of SARS-CoV-2 (FIG. 5F). The variants with and without the collectrin domain contained either wild-type human ACE2 sequences, A25V, or A342V. These neutralization assays were performed using SARS coronavirus S protein pseuodoviruses on MLV vectors encoding Firefly luciferase. The dashed lines indicate 80% neutralization. The effects of A25V and A342V on binding of ACE2-Ig with and without the collectrin domain to the SARS-CoV-2 receptor-binding domain (RBD) were measured by ELISA (FIG. 5G). ACE2-Ig variants containing A25V and A342V alone and in combination were evaluated for virus neutralization potency against furin (−) SARS-CoV-2 pseudoviruses (FIG. 5H).

FIGS. 6A-B provides bar graphs of the melting temperatures measured by differential scanning fluorometry (DSF) of ACE2-Ig proteins with space-filling mutations. The effects of the space-filling mutations A25V and A342V on thermal stability were measured for variants of ACE2-Ig without the collectrin domain (ACE2-Ig) and with the collectrin domain (ACE2-C-Ig) (FIG. 6A). A second DSF experiment was performed, comparing ACE2-Ig with wild-type sequences against versions containing A25L, A36L, A80V, I88F, and L97F (FIG. 6B).

FIGS. 7A-C provides bar graphs of the melting temperatures measured by DSF of ACE2-Ig proteins with and without mutations that affect substrate binding and catalysis. The thermal stability of ACE2-Ig containing the catalytic site mutations H374N/H378N was compared to the thermal stability of ACE2-Ig with a the wild-type catalytic site intact (FIG. 7A). Several angiotensin II (AngII) substrate-binding mutations were evaluated for thermal stability by DSF as alternatives to H374N/H378N as a means of inactivating the catalytic site without destabilizing ACE2-Ig, including R273Q, H345A, E375A, H505A, and H505L (FIG. 7B). The stability of substitutions that inactivate the catalytic site while introducing a disulfide, H374C/G405C and H374C/S409C, were evaluated by DSF (FIG. 7C).

FIG. 9A is a graph showing the assessment of thermal stability by DSF for ACE2-Ig proteins containing a wild-type ACE2 sequence and muteins comprising the substitutions K74C/S106C; S128C/V343C; and the K74C/S106C+ S128C/V343C combination.

FIG. 9B is a graph showing thermal stability results for a subset of the ACE2-Ig proteins described in FIG. 9A made in the absence of an ACE2 inhibitor (full bars) or the presence of the ACE2 inhibitor MLN-4760 at a concentration of 440 nM (empty bars).

FIG. 9C is a graph showing ACE2-Ig proteins comprising a collectrin domain ("ACE2-C-Ig"), with and without K74C/S106C substitutions, prepared in the presence or absence of the ACE2 inhibitor MLN-4760.

FIG. 9D is a graph showing results from a DSF assay in which ACE2-C-Ig proteins with the following substitutions were compared for their impact on thermal stability: H345I, H345L, H345F, H345Y, and H345W. These ACE2-C-Ig proteins were made in a K74C/S106C/A342V background also comprising a collectrin domain. ACE2-C-Ig proteins comprising K74C/S106C/A342V substitutions and a collectrin domain were produced in the presence and absence of the ACE2 inhibitor MLN-4760 as controls. The variants containing H345I, H345L, H345F, and H345W are all indicated with a dashed black line, due to their similarity, whereas H345Y is indicated with a dotted line. The controls that are not substituted at H345 are indicated in solid lines (gray for absence of inhibitor, black for presence of inhibitor).

FIG. 9E is a graph showing the melting temperatures determined from the data in FIG. 9D.

FIG. 9F is a graph showing results from a DSF assay in which ACE2-C-Ig proteins with comprising the substitutions H345Y, F504W ("H345/F504W"), or the combinations H345L/F504W, H345F/H345W, and H345Y/F504W were compared for their impact on thermal stability. These ACE2-C-Ig proteins were made in a K74C/S106C/A342V background also comprising a collectrin domain. ACE2-C-Ig proteins comprising K74C/S106C/A342V substitutions and a collectrin domain were produced in the presence and absence of the ACE2 inhibitor MLN-4760 as controls.

FIG. 9G is a graph showing the melting temperatures determined from the data in FIG. 9F.

FIG. 10A is a photograph of a native protein electrophoresis gel loaded with ACE2-Ig proteins engineered to contain non-native disulfides in the collectrin domain and size exclusion chromatograms of the same proteins. Collectrin domain is abbreviated "CD." The non-native disulfides are C645-C645 and C714-C714. These were engineered with the substitutions S645C and C714C alone and in combination. The native protein gel appears in FIG. 10A, and the size exclusion chromatography (SEC) chromatogram appears in FIG. 10B. For comparison, the SEC chromatogram for a wild-type human sequence ACE2-Ig protein with no collectrin domain is shown in FIG. 10C.

FIGS. 15A-B provide bar graphs of the melting temperatures measured by DSF of ACE2-Ig proteins with combinations of substitutions that may enhance virus neutralization potency. In the context of ACE2-Ig variants lacking a collectrin domain, an ACE2-Ig protein containing a wild-type ACE2 sequence (SEQ ID NO: 1) was compared against an otherwise-identical ACE2-Ig protein comparing A25V alone, or A25V present in various pairwise combinations including A24V/Q24E, A25V/T27K, A25V/D30E, A25V/H34S, A25V/N90D, and A25V/A342V (FIG. 15A). Melting temperatures were measured for ACE2-Ig proteins containing a collectrin (C) domain (denoted ACE2-C-Ig) and another set of combinations of substitutions, including A25V/N90D/I259S/C261S/A342V plus either L29F, A386L, L29F/A386L, or T27K/H34S/N49E (FIG. 15B).

FIGS. 16 A-C provide graphs depicting the results of SARS-CoV-2 pseudovirus neutralization assays for ACE2-Ig variants containing the indicated combinations of potency-enhancing substitutions. FIG. 16A shows the results of SARS-CoV-2 pseudovirus neutralization assays for ACE2-Ig variants containing pairwise combinations of substitutions including A25V. The combinations containing A25V included A25V/Q24E, A25V/T27K, A25V/D30E, A25V/H34S, A25V/N90D, and A25V/A342V. FIG. 16B shows the results of SARS-CoV-2 pseudovirus neutralization assays for ACE2-Ig variants containing a collectrin (C) domain (denoted ACE2-C-Ig) and combinations of potency-enhancing substitutions. The potency-enhancing substitutions were tested in combination with I259S/C261S substitutions (not shown for simplicity). The combinations of potency-enhancing substitutions all included A25V/N90D/A342V, plus either T27K/H34S/N49E, L29F, A386L, or L29F/A386L. FIG. 16C shows virus neutralization assays with the ACE2-C-Ig variants in FIG. 16B and additional ACE2-C-Ig variants that comprised I259S/C261S (not shown) and A25V/N90D/A342V, plus either L29F/L351F/A386L or T27K/L29F/H34S/N49E/L351F/A386L (FIG. 16C). The concentrations of ACE2-Ig that inhibit 80% of virus infection (the IC80) is indicated in brackets.

FIG. 17A shows a native gel containing ACE2-Ig proteins based on wild-type human ACE2 sequences with a collectrin domain and an IgG1 Fc and the individual substitutions in the collectrin domain V647L, A650I, V670L, V685I, and I695T. Wild-type is abbreviated WT and collectrin domain is abbreviated CD. FIG. 17B shows a native gel containing ACE2-Ig proteins, which all contained the combination of substitutions K74C/S106C/A342V and an IgG2 Fc plus A714C alone, or V647I/V700L/A714C, V647I/V670L/A714C, V647L/A714C, I622L/A714C, I622L/V647I/I679L/A714C, or I622L/I679L/V647I/V670I/A714C. Lanes that were under-loaded with the K74C/S106C/A342V/A714C control are marked with an asterisk. FIG. 17C shows the same ACE2-Ig proteins (containing K74C/S106C/A342V and an IgG2 Fc plus A714C alone, or V647I/V700L/A714C, V647I/V670L/A714C, V647L/A714C, I622L/A714C, I622L/V647I/I679L/A714C, or I622L/I679L/V647I/V670I/A714C) separated in a non-reducing SDS protein electrophoresis gel. FIG. 17D shows a native gel containing ACE2-Ig proteins, which all contained the combination of substitutions K74C/S106C/A342V and an IgG2 Fc plus A714C alone, the combination of substitutions V620I/V647I/A714C, or V647I/V700L/A714C. FIG. 17E shows a native gel containing ACE2-Ig proteins based on wild-type human ACE2 sequences with a collectrin domain and an IgG1 Fc and the individual substitutions in the collectrin domain L664G, L664P, V620L, A650V, L656S, M662T, or V685L.

FIG. 20 is a nucleotide sequence alignment of the 5' region of a DNA sequence ("DNA", SEQ ID NO: 122) that encodes an ACE2-Ig and an RNA splicing isoform expressed by this DNA sequence ("Cryptic splicing isoform 1", SEQ ID NO: 123). This DNA sequence codes for an ACE2-Ig protein containing the CD5 signal peptide and the A25V substitution. The region contains an intron and splice acceptor site that are part of the design of the expression system. The amino acid translation of this region of the ACE2 protein is shown ("Expected Amino Acid Sequence", SEQ ID NO: 124). The codon corresponding to Q24 is underlined. An AGGT splice donor sequence formed by the codons encoding Q24 and A25V is shown in bold.

FIGS. 22A-B show a native protein gel and a graph depicting the results of a virus neutralization assay using ACE2-Ig proteins with and without closed substrate-binding clefts. Closing the substrate-binding cleft by producing an ACE2-Ig protein with the substitutions K74C/S106C in the presence of the ACE2 inhibitor MLN-4760 reduced aggregation, as observed on a native protein gel (FIG. 22A). The substitution H345Y replaced MLN-4760 in this context, leading to a modest further reduction in aggregation. SARS-CoV-2 pseudoviruses were neutralized equally effectively by wild-type, K74C/S106C, or K74C/S106C/S128C/V343C variants of ACE2-Ig made in the presence and absence of MLN-4760 (FIG. 22B).

DETAILED DESCRIPTION

Figure 8:
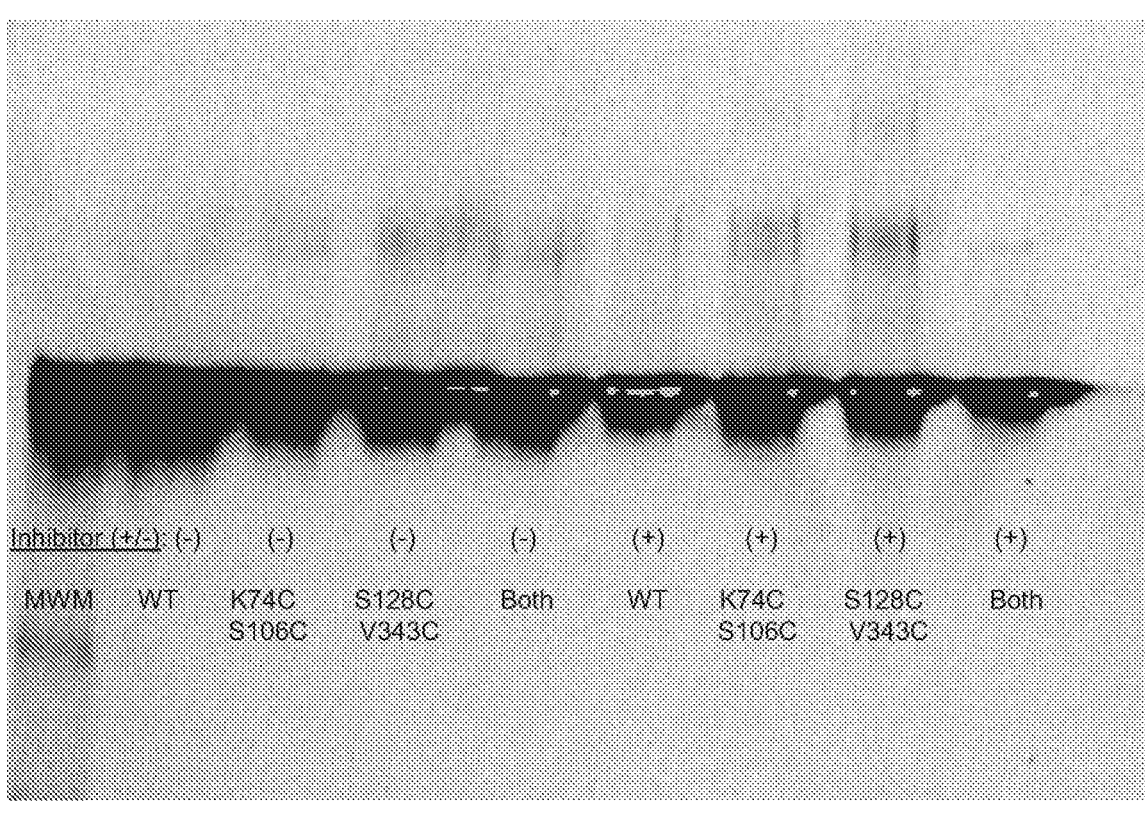
FIG. 8 is a photograph of a native protein electrophoresis gel loaded with ACE2-Ig proteins engineered to contain non-native disulfides on opposite sides of the angiotensin-binding cleft of ACE2, produced in the presence or absence of an ACE2 inhibitor. The presence (+) or absence (−) of the inhibitor is indicated by plus and minus signs. The ACE2 inhibitor used was MLN-4760, and its concentration during protein production was 440 nM. "Both" indicates both pairs of non-native cysteines that expressed in the presence and absence of MLN-4760, K74C/S106C and S128C/V343C. This gel image is saturated, in order to visualize minor oligomeric species. Areas of saturation appear as light spots on a black background. A molecular weight marker (MWM) was included.

The invention is based, in part, on the discovery of ACE2 mutant proteins (muteins) having greater stability and/or activity than ACE2 proteins based on naturally-occurring human ACE2. In certain embodiments, the proteins exhibit improved thermal stability, e.g., as measured by differential scanning fluorometry (DSF) or dynamic light scattering (DLS); improved plasma half-lives compared to naturally-occurring human ACE2; improved bioavailability compared to naturally-occurring human ACE2; improved binding to SARS coronavirus spike (S) proteins compared to naturally-occurring human ACE2; and/or improved neutralization of SARS coronaviruses or SARS coronavirus S protein pseudoviruses compared to naturally-occurring human ACE2. In addition, the invention is based, in part, upon the discovery that the mutations used to inactivate the enzymatic activity of ACE2 are destabilizing.

In certain embodiments, the disclosure relates to ACE2 muteins comprising substitutions of amino acids in the hydrophobic interior of ACE2. For example, ACE2 muteins can include substitutions near where ACE2 contacts the receptor binding domain (RBD) of SARS coronavirus S proteins (i.e., the region from S19-S106 and P336-M360 of SEQ ID NO: 1) to improve binding affinity for the RBD and neutralization of SARS coronaviruses. Specifically, substitutions of buried amino acids in the region from S19-S106 and P336-M360 of wild-type human ACE2 with hydrophobic or aromatic amino acids having more carbon atoms or greater molecular weights than the amino acids being replaced can fill spaces within the hydrophobic interior of the protein, thereby increasing the stability of RBD contacts.

Mutations reducing or eliminating the catalytic activity of ACE2 may be desirable; however, known catalytic mutations also affect the stability of ACE2, making production of such proteins difficult. Accordingly, in certain embodiments, the disclosure provides ACE2 muteins comprising substitutions affecting substrate binding, which can reduce or eliminate catalytic activity of ACE2 without destabilizing the molecule. Similarly, the disclosure provides ACE2 muteins comprising substitutions that reduce substrate accessibility to (e.g., close) the substrate-binding cleft, which can improve stability and pharmacokinetics (PK) while also providing an alternate means of rendering the protein catalytically inactive.

In certain embodiments, the ACE2 mutein comprises the collectrin domain of ACE2. The disclosure also relates to substitutions that stabilize the collectrin domain of ACE2, including substitutions that stabilize the homodimerization interface of the collectrin domain, which resulted in enhanced virus neutralization.

The proteins, compositions, and methods disclosed herein can be used to treat infection with SARS-CoV, SARS-CoV-2, or HCoV-NL63 in a subject. For example, an ACE2 mutein can be administered to a subject in an effective amount, either alone or in a combination with another therapeutic agent, to treat the coronavirus infection in the subject. The disclosure also provides a methods of preventing the S protein of a SARS coronavirus from binding to endogenous ACE2 and blocking the entry of SARS-CoV, SARS-CoV-2, or HCoV-NL63 into a host cell, e.g., a human host cell. The disclosure also provides a method of treating the acute respiratory distress that is a hallmark of SARS coronavirus infection.

I. Proteins Comprising an ACE2 Mutein

In one aspect, the invention provides a protein comprising a human angiotensin-converting enzyme 2 (ACE2) mutein. An ACE2 mutein is a protein having at least one insertion, deletion, or substitution as compared to wild-type human ACE2 (SEQ ID NO: 1).

In certain embodiments, the at least one insertion, deletion, or substitution increases the binding affinity of the ACE2 mutein for a spike (S) protein of SARS-CoV-1 or SARS-CoV-2 relative to human ACE2 that does not comprise the at least one insertion, deletion, or substitution. In certain embodiments, the binding activity of the ACE2 mutein is increased by 5%, 10%, 20%, 30%, 40%, 50%, 60%, 70%, 80%, 90%, 100%, 150%, 200%, 250%, 500% or more relative to wild type ACE2.

Binding affinity can be measured by any method known in the art, including for example, surface plasmon resonance (SPR), ELISA or other immunoassay, FACS analysis, or Octet binding analysis.

In certain embodiments, the at least one insertion, deletion, or substitution decreases the concentration of the protein needed to neutralize 80% of the infectivity of a virus or pseudovirus comprising the spike (S) protein of SARS-CoV-1 or SARS-CoV-2 relative to human ACE2. In certain embodiments, the concentration of the mutein needed to neutralize 80% of the infectivity of a virus or pseudovirus comprising the spike (S) protein of SARS-CoV-1 or SARS-CoV-2 relative to human ACE2 is reduced by more than 90%, more than 80%, more than 70%, more than 60%, more than 50%, more than 40%, more than 30%, more than 20%, or more than 10%.

In certain embodiments, the neutralizing activity of the ACE2 mutein is increased by 5%, 10%, 20%, 30%, 40%, 50%, 60%, 70%, 80%, 90%, 100%, 150%, 200%, 250%, 500% or more relative to wild type ACE2.

Neutralization activity can be measured by any means known in the art, including, for example, using SARS coronavirus S protein pseuodoviruses on MLV vectors encoding Firefly luciferase, incubating the pseudoviruses with the mutein, adding ACE2 expressing cells, and measuring luciferase activity.

In certain embodiments, the at least one insertion, deletion, or substitution increases the stability of the ACE2 mutein relative to wild-type human ACE2. In certain embodiments, the stability of the ACE2 mutein is increased by 5%, 10%, 20%, 30%, 40%, 50%, 60%, 70%, 80%, 90%, 100%, 150%, 200%, 250%, 500% or more relative to wild type ACE2.

Stability can be measured by any means known in the art, including, for example, by differential scanning fluorometry (DSF).

In certain embodiments, the at least one insertion, deletion, or substitution increases the plasma half-life of the ACE2 mutein relative to wild-type human ACE2. In certain embodiments, the plasma half-life of the ACE2 mutein is increased by 5%, 10%, 20%, 30%, 40%, 50%, 60%, 70%, 80%, 90%, 100%, 150%, 200%, 250%, 500% or more relative to wild type ACE2.

In certain embodiments, the ACE2 mutein comprises an amino acid sequence at least 80% identical to wild-type human ACE2 (SEQ ID NO: 1). For example, the ACE2 mutein may be at least 85%, at least 90%, at least 95%, at least 96%, at least 97%, at least 98%, at least 99%, at least 99.5%, or at least 99.8% identical to wild-type human ACE2 (SEQ ID NO: 1).

In certain embodiments, the ACE2 mutein comprises an amino acid sequence at least 80% identical to amino acids 19-615 of wild-type human ACE2 (SEQ ID NO: 1). For example, the ACE2 mutein may be at least 85%, at least 90%, at least 95%, at least 96%, at least 97%, at least 98%, at least 99%, at least 99.5%, or at least 99.8% identical to amino acids 19-615 of wild-type human ACE2 (SEQ ID NO: 1). In certain embodiments, the ACE2 mutein does not comprise amino acids 1-18 and/or 616-805 of wild-type human ACE2 (SEQ ID NO: 1).

Sequence identity may be determined in various ways that are within the skill of a person skilled in the art, e.g., using publicly available computer software such as BLAST, BLAST-2, ALIGN or Megalign (DNASTAR) software. BLAST (Basic Local Alignment Search Tool) analysis using the algorithm employed by the programs blastp, blastn, blastx, tblastn and tblastx (Karlin et al., (1990) Proc. Natl. Acad. Sci. Usa 87:2264-2268; Altschul, (1993) J. Mol. Evol. 36:290-300; Altschul et al., (1997) Nucleic Acids Res. 25:3389-3402, incorporated by reference herein) are tailored for sequence similarity searching. For a discussion of basic issues in searching sequence databases see Altschul et al., (1994) Nature Genetics 6:119-129, which is fully incorporated by reference herein. Those skilled in the art can determine appropriate parameters for measuring alignment, including any algorithms needed to achieve maximal alignment over the full length of the sequences being compared. The search parameters for histogram, descriptions, alignments, expect (i.e., the statistical significance threshold for reporting matches against database sequences), cutoff, matrix and filter are at the default settings. The default scoring matrix used by blastp, blastx, tblastn, and tblastx is the BLOSUM62 matrix (Henikoff et al., (1992) Proc. Natl. Acad. Sci. USA 89:10915-10919, fully incorporated by reference herein). Four blastn parameters may be adjusted as follows: Q=10 (gap creation penalty); R=10 (gap extension penalty); wink=1 (generates word hits at every wink.sup.th position along the query); and gapw=16 (sets the window width within which gapped alignments are generated). The equivalent blastp parameter settings may be Q=9; R=2; wink=1; and gapw=32. Searches may also be conducted using the NCBI (National Center for Biotechnology Information) BLAST Advanced Option parameter (e.g.: -G, Cost to open gap [Integer]: default=5 for nucleotides/11 for proteins; -E, Cost to extend gap [Integer]: default=2 for nucleotides/1 for proteins; -q, Penalty for nucleotide mismatch [Integer]: default=-3; -r, reward for nucleotide match [Integer]: default=1; -e, expect value [Real]: default=10; -W, wordsize [integer]: default=11 for nucleotides/28 for megablast/3 for proteins; -y, Dropoff(X) for blast extensions in bits: default=20 for blastn/7 for others; -X, X dropoff value for gapped alignment (in bits): default=15 for all programs, not applicable to blastn; and -Z, final X dropoff value for gapped alignment (in bits): 50 for blastn, 25 for others). ClustalW for pairwise protein alignments may also be used (default parameters may include, e.g., Blosum62 matrix and Gap Opening Penalty=10 and Gap Extension Penalty=0.1). A Bestfit comparison between sequences, available in the GCG package version 10.0, uses DNA parameters GAP=50 (gap creation penalty) and LEN=3 (gap extension penalty). The equivalent settings in Bestfit protein comparisons are GAP=8 and LEN=2.

In certain embodiments, the substitution is at a position corresponding to I21, E22, A25, N33, A36, F40, S43, S44, S47, N51, G66, L73, Q76, A80, I88, L91, V93, Q96, L97, Q98, A99, Q101, C131, V132, C141, L144, A164, S167, V172, L176, A191, N194, V209, V212, V226, T229, H241, L248, A251, C261, R273, T282, V293, A311, F315, V318, S331, L333, A342, V343, A443, L351, T362, A372, H373, G377, Q380, D382, A386, H373, N397, V404, S411, A412, T414, I421, G422, L423, L440, A443, V447, G448, T449, L450, T454, E457, R460, V463, M474, G486, V487, V488, V491, H493, C498, A501, T517, T519, Q526, L558, G561, A569, or V573 of wild-type human ACE2 (SEQ ID NO: 1).

In certain embodiments, the human ACE2 mutein comprises one or more of the following substitutions: I21P, I21F, I21W, E22L, E22I, E22F, E22Y, A25V, N33L, A36V, F40Y, S43C, S44V, S44I, S44M, S47T, N51V, G66A, G66C, L73F, L73Y, Q76I, A80V, A80I, I88F, L91P, V93I, V93L, Q96L, L97F, Q98L, A99V, A99L, A99F, A99Y, Q101L, Q101M, C131S, V132I, V132L, C141S, L144F, A164, S167T, V172, L176M, A191V, N194I, N194L, V209I, V209L, V209M, V212I, V212L, V212F, V212Y, V226L, T229V, H241F, L248M, A251V, C261V, C261I, C261M, R273F, T282M, T282V, T282I, T282L, V293I, V293L, A311V, F315Y, V318I, V318L, S331T, S331V, S331I, L333F, A342V, V343I, L351F, T362V, T362I, T362L, A372V, H373F, H373Y, G377A, Q380I, Q380M, D382L, A386, H373, N397L, V404I, V404L, S411T, S411V, A412, T414V, I421M, G422A, L423F, L440F, A443V, V447L, G448A, G448V, T449V, L450M, T454V, E457L, R460L, R460M, V463L, V463F, M474I, G486A, V487I, V488M, V491I, V491L, V491M, H493F, C498M, C498V, C598I, C598M, A501V, T517V, T517I, T517L, T517M, T519V, T519I, T519L, T519M, Q526H, Q526L, Q526M, Q526F, L558M, G561A, A569L, V573M, or V573M of wild-type human ACE2 (SEQ ID NO: 1).

In certain embodiments, the substitution is at a position corresponding to I21, A25, A36, L73, V93, L97, A99, A342, or V343 of human ACE2 (SEQ ID NO: 1).

In certain embodiments, the substitution is at least one of A25V or A342V.

A. Substitutions Identified by Comparison to Non-Human Primates and Non-Primate Mammals, Space-Fitting Models and Algorithms In certain embodiments, the ACE2 mutein comprises one or more amino acid substitutions, wherein the substitution is at a position having a different amino acid in a non-human mammal ACE2 as compared to human ACE2 (SEQ ID NO: 1). In certain embodiments, the substitution replaces the amino acid present at a position in human ACE2 (SEQ ID NO: 1) with the amino acid present at the corresponding position in a non-human mammal ACE2.

In certain embodiments, the substitution replaces the amino acid present at a position in human ACE2 (SEQ ID NO: 1) with the amino acid present at the corresponding position in a non-human primate ACE2. In certain embodiments, the ACE2 mutein comprises at least one substitution at a position corresponding to I21, A25, A36, F40, S44, L73, A80, V93, A99, A164, V172, V212, A251, V318, A342, V343, A412, V491, L558, or V573 of wild-type human ACE2 (SEQ ID NO: 1). In certain embodiments, the substitution is a substitution identified in TABLE 1.

In certain embodiments, the substitution is derived from a space-fitting model or algorithm. For example, the ACE2 mutein can include at least one substitution at a position corresponding to A25, A36, A80, L97, V132, L144, A164, A191, V226, V293, A311, V318, L333, A372, G377, V404, G422, L423, A443, V447, G448, V463, G486, V487, A501, G561, or A569 of wild-type human ACE2 (SEQ ID NO: 1). In certain embodiments, the substitution is a substitution identified in TABLE 1.

TABLE 1

| Amino Acid in human ACE2 | Substitution |
|---|---|
| I21 | P in tarsier, F or W by space-fitting model, M, H, Y |
| A25 | V in tarsier, P, I, M, H, F, Y, W |
| A3 6 | V in galago, P, I, L, M, H, F, Y, W |
| L73 | F in new world primates, Y in prosimians, M, H, W |
| V93 | I in tarsiers and gray mouse lemurs, I and L in various mammals, M, H, F, Y, W |
| A99 | V in gray mouse lemur and brown bats, I in flying foxes, P, L, M, H, F, Y, W |
| A164 | V in tarsier and brown bats, V and L by algorithm, V, I, and L by space-fitting model, P, M, H, F, Y, W |
| VI72 | I in marmoset, Ma's night monkey, and tarsier, L, M, H, F, Y, W |
| A251 | V in capuchins, gray mouse lemur, rat, and black flying fox, P, I, L, M, H, F, Y, W |
| V318 | I in snub-nosed monkeys, ungulates, and whales, L in flying foxes, L by algorithm, M, H, F, Y, W |
| A342 | V in all primates except great apes, V in all mammals, I by space-filling model, P, I, L, M, H, F, Y, W |
| V343 | I in lemur and sifaka, L, M, H, F, Y, W |
| L359 | I in all old world monkeys except colobus, M, H, F, Y, W |
| A412 | V in galago and bats, I by space-filling model, P, L, M, H, F, Y, W |
| V491 | L in tarsier, galago, sifaka, and various mammals, M in rabbits, I by space-filling model, H, F, Y, W |
| L520 | I in prosimians and other mammals, M, H, F, Y, W |
| L558 | M in galago, H, F, Y, W |
| V573 | I in tarsier, bats, ungulates, whales, and by algorithm, M in wombat, L, H, F, Y, W |

In certain embodiments, the ACE2 mutein comprises one or more amino acid substitutions, wherein the substitution is at a position having a different amino acid in a non-primate mammal ACE2 as compared to human ACE2 (SEQ ID NO: 1). In certain embodiments, the substitution replaces the amino acid present at a position in human ACE2 (SEQ ID NO: 1) with the amino acid present at the corresponding position in a non-primate mammal ACE2, as identified in TABLE 2. In certain embodiments, the substitution is derived from a space-fitting model or algorithm.

In certain embodiments, the ACE2 mutein comprises at least one substitution at a position corresponding to I21, A25, A36, F40, S44, G66, L73, A80, I88, L91, V93, A99, A164, S167, V172, L176, N194, V209, V212, T229, H241, L248, A251, C261, R273, F315, V318, A342, V343, L351, A386, V404, A412, I421, L440, L450, M474, V488, V491, L558, or V573 of wild-type human ACE2 (SEQ ID NO: 1).

TABLE 2

| Amino Acid in human ACE2 | Substitution |
|---|---|
| F40 | Y in tarsier and panda, W |
| G66 | A in mouse, rat, and wombat, P, V, I, L, M, F, Y, W |
| A80 | V by algorithm, I by space-filling model, P, L, M, H, F, Y, W |
| I88 | V in rabbits, F by space-filling model, M, H, Y, W |
| L91 | P in mice, A in civets, M, H, F, Y, W |
| L95 | M, H, F, Y, W |
| VI32 | I in wombat, L by algorithm, M, H, F, Y, W |
| L176 | M in wombat, H, F, Y, W |
| V209 | A in various, I, L, M by space-filling model, H, F, Y, W |
| V212 | A in other mammals, I, L, F, Y by space-filling model, M, H, W |
| I233 | V in galago, M, H, F, Y, W |
| L248 | M in wombat, H, F, Y, W |
| I256 | V in galago, M, H, F, Y, W |
| F308 | L in gray mouse lemur, Y, W |
| F315 | Y in big brown bat, W |
| A3 86 | P, V, I, L, M, IL F, Y, W |
| P389 | P, V, I, L, M, H, F, Y, W |
| V404 | I in panda, L by algorithm, M, H, F, Y, W |
| I407 | V in brown bats and flying foxes, M, H, F, Y, W |
| M408 | I in flying foxes, L, H, F, Y, W |
| I421 | L in vampire bat, wombat, ungulates, and whales, M in brown bats and flying fox, H, F, Y, W |

TABLE 2-continued

| Amino Acid in human ACE2 | Substitution |
|---|---|
| L440 | F in seal and sea lion, M, H, Y, W |
| L450 | M in wombat, H, F, Y, W |
| M474 | I in monk seal, I, L, H, F, Y, W |
| V488 | M in little brown bat, I, L, H, F, Y, W |

B. Buried Hydrophilic Substitutions

In certain embodiments the ACE2 mutein comprises one or more substitutions of a buried amino acid in wild-type human ACE2 (SEQ ID NO: 1) by a hydrophobic or aromatic amino acid having more carbon atoms or a greater molecular weight than the amino acid that is replaced. In certain embodiments, the ACE2 mutein comprises one or more substitutions of an at least partially buried serine in wild-type human ACE2 (SEQ ID NO: 1) by a threonine.

The number of carbon atoms and molecular weights of the standard amino acids are provided in TABLE 3.

TABLE 3

| Amino Acid | Property | Number of Carbon Atoms | Molecular Weight (g/mol) |
|---|---|---|---|
| Glycine | Special | 2 | 75.1 |
| Alanine | Hydrophobic | 3 | 89.1 |
| Serine | Hydrophilic | 3 | 105.1 |
| Cysteine | Hydrophilic | 3 | 121.2 |
| Threonine | Hydrophilic | 4 | 119.1 |
| Proline | Hydrophobic | 5 | 115.1 |
| Valine | Hydrophobic | 5 | 117.1 |
| Asparagine | Hydrophilic | 4 | 132.1 |
| Aspartate | Hydrophilic | 4 | 133.1 |
| Glutamate | Hydrophilic | 5 | 147.1 |
| Glutamine | Hydrophilic | 5 | 146.2 |
| Lysine | Hydrophilic | 6 | 146.2 |
| Arginine | Hydrophilic | 6 | 174.2 |
| Isoleucine | Hydrophobic | 6 | 131.2 |
| Leucine | Hydrophobic | 6 | 131.2 |
| Methionine | Hydrophobic | 5 | 149.2 |
| Histidine | Aromatic | 6 | 155.2 |
| Phenylalanine | Aromatic | 9 | 165.2 |
| Tyrosine | Aromatic | 9 | 181.2 |
| Try ptophan | Aromatic | 11 | 204.2 |

An amino acid can be considered to be buried if it is not solvent-accessible as determined by a computational tool for determining the fractional accessible surface area (ASA) for the amino acid. A web-based computational tool, named Volume Area Dihedral Angle Reporter (VADAR) (website located at redpoll.pharmacy.ualberta.ca/vadar) (Willard et al., (2003) Nucleic Acids Res. 31(13):3316-9), was used to calculate the fractional ASA values (TABLE 4). The ACE2 structures used as inputs for VADAR were PDB codes 1R42 for amino acids 19-615 of human ACE2 (SEQ ID NO: 1), and 6M17 for amino acids 616-740 of human ACE2 (SEQ ID NO: 1). As explained in greater depth by Willard et al., and the references therein, ASA values are calculated by dividing the solvent-accessible surface area of the amino acid in the structure by the solvent-accessible surface area of the same amino acid when present in an extended G-X-G tripeptide, where X represents the amino acid. This approach is often in agreement with a visual assessment of the three-dimensional representation structural data. Indeed, the disposition of every amino acid from S19-S740 of human ACE2 (SEQ ID NO: 1) was assessed visually by inspecting the structures 1R42 for amino acids S19-D615 and 6M17 for amino acids Q616-S740, and the differences between fractional ASA values determined by visual assessment among exposed, partially-exposed, and buried amino acids was highly significant (P<0.0001 for all pairwise comparisons) (FIG. 4A). Therefore, fractional ASA values reported by VADAR reliably predict whether a residue appears to be exposed, partially-exposed, or buried by visual inspection of protein structures.

The solvent-accessibility of an amino acid can be predicted by any means known in the art. Generally, a fixed-length window is opened around the residue of interest and a feature vector is computed based on the sequence information within this window. Features used can include residue types (Ganesan et al. (2012) Protein Pept Lett 19(1): 50-67), position specific scoring matrix (PSSM) (Rajkumar et al. (2008) Comput Syst Bioinforma 7:195-202), and predicted secondary structure (SS) (Zhang et al. (2015) Biodata Min. 8(1):1-15). The real solvent accessibility of the residue of interest also can be computed using the dictionary of protein secondary structure (DSSP) as burial state labels (Pauling et al. (1951) PNAS 37(11):729-740). Feature vectors along with burial state labels can be entered into a machine learning model such as artificial neural network (ANN) (Magnan et al. (2015) Bioinformatics 30(18):2592-7, support vector machine (SVM) (Jung-Ying et al. (2007) Proteins Struct Funct Bioinforma 68(1):82-91), deep learning model Yang et al. (2015) Sci Rep doi:10.1038/sieo11476), conditional neural field (CNF) (Ma el al. (2015) Biomed Res Int. doi:10.1155/2015/678764), and random forest (RF) (Ganesan et al. (2012) Protein Pept Lett. 19(1):50-67) for training. The trained model can then be used to predict solvent accessibility of an amino acid in a testing set such as bidirectional recurrent neural network (BRNN) used in softwares such as SCRATCH (Cheng et al. (2010) Nucleic Acids Res. 33:72-65) and ACCpro (Magnan et al. (2014) Bioinformatics 30(18):2592-7).

Fractional ASA values were analyzed to identify amino acids with increased or decreased exposure in different structures. For instance, the extent of solvent accessibility often changed in the native ACE2 structure (1R42) versus the inhibitor-bound ACE2 structure (1R4L) (TABLE 4). Those amino acids having greater fractional ASA values in 1R42 than 1R4L (i.e., those with positive differences when the fractional ASA value from 1R4L is subtracted from that of 1R42) are those that become relatively more buried in the inhibitor-bound conformation. The most positive differences obtained by subtracting the fractional ASA values of 1R4L from those of 1R42 were identified for amino acid positions with a buried disposition (FIG. 4B) and a partially-buried disposition (FIG. 4C). Amino acid positions with the greatest changes in fractional ASA values were selected as candidates for mutagenesis to stabilize the inhibitor-bound conformation.

Likewise, the native structure 1R42 was compared with the SARS-CoV-2 RBD-bound structure 6M17 to identify amino acid positions with the greatest difference in fractional ASA when the SARS-CoV-2 RBD is bound or when the collectrin domain is present. 6M17 also differs from 1R42 in that 6M17 includes the collectrin domain, in addition to the SARS CoV-2 RBD. Those amino acids having greater fractional ASA values in 1R42 than 6M17 (i.e., those with positive differences when the fractional ASA value from 6M17 is subtracted from that of 1R42) are those that become less solvent-exposed in the RBD-bound conformation, or become less solvent-exposed when the collectrin domain is present. The most positive differences obtained by subtracting the fractional ASA values of 6M17 from those of 1R42 were identified for amino acid positions with a buried disposition (FIG. 4D) and a partially-buried disposition (FIG. 4E). Amino acid positions with the greatest changes in fractional ASA values were selected as candidates to stabilize interactions with the SARS coronavirus S protein RBD or the collectrin domain.

In certain embodiments, the ACE2 mutein comprises one or more amino acid substitutions at a position with a buried amino acid side chain in human ACE2 (SEQ ID NO: 1). In certain embodiments, the one or more amino acid substitutions is selected from the substitutions identified in TABLE 4.

TABLE 4

| Amino Acid in Human ACE2 | Disposition | Fractional SASA | | | Differences in Fractional ASA | |
|---|---|---|---|---|---|---|
| | | 1R42 | 1R4L | 6M17 | 1R42 – IR4L | 1R42 – 6M17 |
| S19 | Exposed | 0.75 | 0.94 | | −0.19 | |
| T20 | Exposed | 0.65 | 0.8 | | −0.15 | |
| I21 | Partial | 0.37 | 0.46 | 0.68 | −0.09 | −0.31 |
| E22 | Partial | 0.16 | 0.1 | 0.23 | 0.06 | −0.07 |
| E23 | Exposed | 0.6 | 0.42 | 0.67 | 0.18 | −0.07 |
| Q24 | Exposed | 0.27 | 0.49 | 0.62 | −0.22 | −0.35 |
| A25 | Buried | 0 | 0.01 | 0 | −0.01 | 0 |
| K26 | Partial | 0.41 | 0.35 | 0.5 | 0.06 | −0.09 |
| T27 | Exposed | 0.54 | 0.53 | 0.76 | 0.01 | −0.22 |
| F28 | Buried | 0.08 | 0.05 | 0.13 | 0.03 | −0.05 |
| L29 | Buried | 0.05 | 0.05 | 0.03 | 0 | 0.02 |
| D30 | Exposed | 0.68 | 0.61 | 0.68 | 0.07 | 0 |
| K31 | Exposed | 0.8 | 0.83 | 0.79 | −0.03 | 0.01 |
| F32 | Buried | 0 | 0.01 | 0.01 | −0.01 | −0.01 |
| N33 | Partial | 0.18 | 0.13 | 0.13 | 0.05 | 0.05 |
| H34 | Exposed | 0.74 | 0.7 | 0.75 | 0.04 | −0.01 |
| E35 | Exposed | 0.59 | 0.56 | 0.51 | 0.03 | 0.08 |
| A36 | Buried | 0 | 0 | 0 | 0 | 0 |
| E37 | Partial | 0.22 | 0.24 | 0.24 | −0.02 | −0.02 |
| D38 | Exposed | 0.65 | 0.56 | 0.59 | 0.09 | 0.06 |
| L39 | Partial | 0.2 | 0.15 | 0.23 | 0.05 | −0.03 |
| F40 | Partial | 0.36 | 0.37 | 0.35 | −0.01 | 0.01 |
| Y41 | Partial | 0.27 | 0.22 | 0.24 | 0.05 | 0.03 |
| Q42 | Exposed | 0.55 | 0.56 | 0.52 | −0.01 | 0.03 |
| S43 | Exposed | 0.14 | 0.14 | 0.1 | 0 | 0.04 |
| S44 | Partial | 0.11 | 0.08 | 0.13 | 0.03 | −0.02 |
| L45 | Partial | 0.38 | 0.38 | 0.36 | 0 | 0.02 |
| A46 | Partial | 0.12 | 0.19 | 0.17 | −0.07 | −0.05 |
| S47 | Exposed | 0.29 | 0.3 | 0.22 | −0.01 | 0.07 |
| W48 | Buried | 0.06 | 0.06 | 0.05 | 0 | 0.01 |
| N49 | Exposed | 0.45 | 0.52 | 0.54 | −0.07 | −0.09 |
| Y50 | Partial | 0.23 | 0.03 | 0.26 | 0.2 | −0.03 |
| N51 | Partial | 0.19 | 0.22 | 0.2 | −0.03 | −0.01 |
| T52 | Partial | 0.11 | 0.14 | 0.18 | −0.03 | −0.07 |
| N53 | Exposed | 0.41 | 0.28 | 0.45 | 0.13 | −0.04 |
| I54 | Partial | 0.24 | 0.07 | 0.22 | 0.17 | 0.02 |
| T55 | Partial | 0.37 | 0.46 | 0.55 | −0.09 | −0.18 |
| E56 | Exposed | 0.85 | 0.49 | 0.81 | 0.36 | 0.04 |
| E57 | Exposed | 0.69 | 0.76 | 0.85 | −0.07 | −0.16 |
| N58 | Exposed | 0.2 | 0.19 | 0.18 | 0.01 | 0.02 |
| V59 | Partial | 0.33 | 0.14 | 0.35 | 0.19 | −0.02 |
| Q60 | Exposed | 0.59 | 0.57 | 0.73 | 0.02 | −0.14 |
| N61 | Exposed | 0.63 | 0.62 | 0.57 | 0.01 | 0.06 |
| M62 | Partial | 0.22 | 0.17 | 0.23 | 0.05 | −0.01 |
| N63 | Exposed | 0.46 | 0.28 | 0.55 | 0.18 | −0.09 |
| N64 | Exposed | 0.54 | 0.61 | 0.59 | −0.07 | −0.05 |
| A65 | Partial | 0.24 | 0.2 | 0.16 | 0.04 | 0.08 |
| G66 | Exposed | 0.38 | 0.36 | 0.4 | 0.02 | −0.02 |
| D67 | Exposed | 0.78 | 0.67 | 0.74 | 0.11 | 0.04 |
| K68 | Exposed | 0.73 | 0.65 | 0.59 | 0.08 | 0.14 |
| W69 | Partial | 0.15 | 0.17 | 0.18 | −0.02 | −0.03 |
| S70 | Exposed | 0.65 | 0.63 | 0.67 | 0.02 | −0.02 |
| A71 | Exposed | 0.69 | 0.59 | 0.57 | 0.1 | 0.12 |
| F72 | Partial | 0.11 | 0.08 | 0.15 | 0.03 | −0.04 |
| L73 | Partial | 0.36 | 0.33 | 0.38 | 0.03 | −0.02 |
| K74 | Exposed | 0.66 | 0.5 | 0.77 | 0.16 | −0.11 |
| E75 | Exposed | 0.68 | 0.54 | 0.67 | 0.14 | 0.01 |
| Q76 | Partial | 0.1 | 0.09 | 0.17 | 0.01 | −0.07 |
| S77 | Partial | 0.12 | 0.03 | 0.21 | 0.09 | −0.09 |
| T78 | Exposed | 0.42 | 0.54 | 0.66 | −0.12 | −0.24 |
| L79 | Exposed | 0.52 | 0.57 | 0.51 | −0.05 | 0.01 |

TABLE 4-continued

| Amino Acid in | | Fractional SASA | | | Differences in Fractional ASA | |
|---|---|---|---|---|---|---|
| Human ACE2 | Disposition | 1R42 | 1R4L | 6M17 | 1R42 − IR4L | 1R42 − 6M17 |
| A80 | Buried | 0 | 0 | 0 | 0 | 0 |
| Q81 | Partial | 0.4 | 0.4 | 0.35 | 0 | 0.05 |
| M82 | Exposed | 0.63 | 0.7 | 0.73 | −0.07 | −0.1 |
| Y83 | Partial | 0.07 | 0.07 | 0.21 | 0 | −0.14 |
| P84 | Partial | 0.39 | 0.5 | 0.53 | −0.11 | −0.14 |
| L85 | Exposed | 0.67 | 0.75 | 0.32 | −0.08 | 0.35 |
| Q86 | Exposed | 0.96 | 0.55 | 0.92 | 0.41 | 0.04 |
| E87 | Exposed | 0.54 | 0.65 | 0.5 | −0.11 | 0.04 |
| I88 | Buried | 0 | 0.02 | 0.02 | −0.02 | −0.02 |
| Q89 | Exposed | 0.9 | 0.93 | 0.86 | −0.03 | 0.04 |
| N90 | Partial | 0.36 | 0.57 | 0.57 | −0.21 | −0.21 |
| L91 | Exposed | 0.49 | 0.77 | 0.46 | −0.28 | 0.03 |
| T92 | Exposed | 0.52 | 0.32 | 0.45 | 0.2 | 0.07 |
| V93 | Buried | 0.08 | 0.13 | 0.06 | −0.05 | 0.02 |
| K94 | Partial | 0.27 | 0.47 | 0.36 | −0.2 | −0.09 |
| L95 | Partial | 0.3 | 0.28 | 0.37 | 0.02 | −0.07 |
| Q96 | Buried | 0.06 | 0.06 | 0.06 | 0 | 0 |
| L97 | Buried | 0 | 0.01 | 0 | −0.01 | 0 |
| Q98 | Exposed | 0.61 | 0.61 | 0.5 | 0 | 0.11 |
| A99 | Partial | 0.43 | 0.45 | 0.37 | −0.02 | 0.06 |
| L100 | Buried | 0.04 | 0.05 | 0.02 | −0.01 | 0.02 |
| Q101 | Partial | 0.11 | 0.27 | 0.22 | −0.16 | −0.11 |
| Q102 | Exposed | 0.58 | 0.57 | 0.38 | 0.01 | 0.2 |
| N103 | Exposed | 0.34 | 0.4 | 0.53 | −0.06 | −0.19 |
| G104 | Buried | 0.21 | 0.73 | 0.29 | −0.52 | −0.08 |
| S105 | Exposed | 0.47 | 0.38 | 0.61 | 0.09 | −0.14 |
| S106 | Exposed | 0.37 | 0.26 | 0.59 | 0.11 | −0.22 |
| V107 | Buried | 0.24 | 0.22 | 0.19 | 0.02 | 0.05 |
| L108 | Buried | 0.04 | 0 | 0.05 | 0.04 | −0.01 |
| S109 | Exposed | 0.77 | 0.73 | 0.63 | 0.04 | 0.14 |
| E110 | Exposed | 0.82 | 0.78 | 0.78 | 0.04 | 0.04 |
| D111 | Exposed | 0.95 | 0.69 | 0.79 | 0.26 | 0.16 |
| K112 | Exposed | 0.43 | 0.4 | 0.43 | 0.03 | 0 |
| S113 | Partial | 0.2 | 0.26 | 0.27 | −0.06 | −0.07 |
| K114 | Exposed | 0.74 | 0.6 | 0.73 | 0.14 | 0.01 |
| R115 | Exposed | 0.45 | 0.4 | 0.46 | 0.05 | −0.01 |
| L116 | Buried | 0.01 | 0.03 | 0.05 | −0.02 | −0.04 |
| N117 | Exposed | 0.59 | 0.49 | 0.63 | 0.1 | −0.04 |
| T118 | Exposed | 0.45 | 0.65 | 0.63 | −0.2 | −0.18 |
| I119 | Buried | 0 | 0 | 0 | 0 | 0 |
| L120 | Partial | 0.23 | 0.22 | 0.21 | 0.01 | 0.02 |
| N121 | Exposed | 0.71 | 0.22 | 0.77 | 0.49 | −0.06 |
| T122 | Exposed | 0.44 | 0.37 | 0.41 | 0.07 | 0.03 |
| M123 | Buried | 0 | 0 | 0 | 0 | 0 |
| S124 | Exposed | 0.39 | 0.17 | 0.39 | 0.22 | 0 |
| T125 | Exposed | 0.63 | 0.25 | 0.58 | 0.38 | 0.05 |
| I126 | Partial | 0.11 | 0.16 | 0.15 | −0.05 | −0.04 |
| Y127 | Buried | 0.07 | 0.06 | 0.11 | 0.01 | −0.04 |
| S128 | Exposed | 0.69 | 0.19 | 0.61 | 0.5 | 0.08 |
| T129 | Exposed | 0.67 | 0.44 | 0.68 | 0.23 | −0.01 |
| G130 | Partial | 0.21 | 0.15 | 0.24 | 0.06 | −0.03 |
| K131 | Exposed | 0.47 | 0.53 | 0.52 | −0.06 | −0.05 |
| V132 | Buried | 0.02 | 0 | 0 | 0.02 | 0.02 |
| C133 | Exposed | 0.34 | 0.23 | 0.38 | 0.11 | −0.04 |
| N134 | Exposed | 0.2 | 0.16 | 0.26 | 0.04 | −0.06 |
| P135 | Partial | 0.68 | 0.61 | 0.31 | 0.07 | 0.37 |
| D136 | Exposed | 0.89 | 0.87 | 0.92 | 0.02 | −0.03 |
| N137 | Exposed | 0.39 | 0.42 | 0.46 | −0.03 | −0.07 |
| P138 | Exposed | 0.62 | 0.66 | 0.61 | −0.04 | 0.01 |
| Q139 | Exposed | 0.83 | 0.79 | 0.84 | 0.04 | −0.01 |
| E140 | Exposed | 0.56 | 0.56 | 0.58 | 0 | −0.02 |
| C141 | Exposed | 0.2 | 0.34 | 0.21 | −0.14 | −0.01 |
| L142 | Partial | 0.27 | 0.28 | 0.35 | −0.01 | −0.08 |
| L143 | Exposed | 0.4 | 0.34 | 0.33 | 0.06 | 0.07 |
| L144 | Buried | 0.07 | 0.06 | 0.08 | 0.01 | −0.01 |
| E145 | Exposed | 0.66 | 0.17 | 0.79 | 0.49 | −0.13 |
| P146 | Exposed | 0.7 | 0.52 | 0.61 | 0.18 | 0.09 |
| G147 | Partial | 0.2 | 0.17 | 0.35 | 0.03 | −0.15 |
| L148 | Buried | 0 | 0 | 0 | 0 | 0 |
| N149 | Partial | 0.27 | 0.27 | 0.32 | 0 | −0.05 |
| E150 | Exposed | 0.6 | 0.28 | 0.65 | 0.32 | −0.05 |
| I151 | Buried | 0.1 | 0.16 | 0.13 | −0.06 | −0.03 |
| M152 | Buried | 0 | 0 | 0 | 0 | 0 |
| A153 | Exposed | 0.28 | 0.28 | 0.29 | 0 | −0.01 |
| N154 | Exposed | 0.62 | 0.72 | 0.62 | −0.1 | 0 |
| S155 | Partial | 0.19 | 0.12 | 0.21 | 0.07 | −0.02 |

TABLE 4-continued

| Amino Acid in | | Fractional SASA | | | Differences in Fractional ASA | |
|---|---|---|---|---|---|---|
| Human ACE2 | Disposition | 1R42 | 1R4L | 6M17 | 1R42 – IR4L | 1R42 – 6M17 |
| L156 | Exposed | 0.65 | 0.64 | 0.58 | 0.01 | 0.07 |
| D157 | Exposed | 0.59 | 0.62 | 0.62 | −0.03 | −0.03 |
| Y158 | Buried | 0.09 | 0.09 | 0.1 | 0 | −0.01 |
| N159 | Exposed | 0.69 | 0.67 | 0.51 | 0.02 | 0.18 |
| E160 | Exposed | 0.46 | 0.46 | 0.45 | 0 | 0.01 |
| R161 | Buried | 0.03 | 0.03 | 0.04 | 0 | −0.01 |
| L162 | Partial | 0.27 | 0.23 | 0.08 | 0.04 | 0.19 |
| W163 | Partial | 0.23 | 0.29 | 0.15 | −0.06 | 0.08 |
| A164 | Buried | 0 | 0 | 0 | 0 | 0 |
| W165 | Buried | 0 | 0 | 0.01 | 0 | −0.01 |
| E166 | Partial | 0.21 | 0.2 | 0.09 | 0.01 | 0.12 |
| S167 | Partial | 0.11 | 0.07 | 0.08 | 0.04 | 0.03 |
| W168 | Buried | 0 | 0 | 0 | 0 | 0 |
| R169 | Buried | 0.04 | 0.04 | 0.04 | 0 | 0 |
| S170 | Exposed | 0.23 | 0.28 | 0.19 | −0.05 | 0.04 |
| E171 | Exposed | 0.54 | 0.5 | 0.47 | 0.04 | 0.07 |
| V172 | Buried | 0 | 0.01 | 0.01 | −0.01 | −0.01 |
| G173 | Buried | 0 | 0 | 0 | 0 | 0 |
| K174 | Exposed | 0.33 | 0.31 | 0.38 | 0.02 | −0.05 |
| Q175 | Exposed | 0.58 | 0.57 | 0.57 | 0.01 | 0.01 |
| L176 | Buried | 0 | 0 | 0 | 0 | 0 |
| R177 | Buried | 0.06 | 0.04 | 0.07 | 0.02 | −0.01 |
| P178 | Exposed | 0.6 | 0.56 | 0.61 | 0.04 | −0.01 |
| L179 | Partial | 0.17 | 0.17 | 0.16 | 0 | 0.01 |
| Y180 | Buried | 0 | 0 | 0 | 0 | 0 |
| E181 | Exposed | 0.23 | 0.28 | 0.26 | −0.05 | −0.03 |
| E182 | Exposed | 0.37 | 0.36 | 0.38 | 0.01 | −0.01 |
| Y183 | Buried | 0 | 0 | 0 | 0 | 0 |
| V184 | Buried | 0.08 | 0.07 | 0.1 | 0.01 | −0.02 |
| V185 | Exposed | 0.57 | 0.51 | 0.62 | 0.06 | −0.05 |
| L186 | Buried | 0.06 | 0.11 | 0.07 | −0.05 | −0.01 |
| K187 | Buried | 0.07 | 0.08 | 0.07 | −0.01 | 0 |
| N188 | Partial | 0.15 | 0.12 | 0.09 | 0.03 | 0.06 |
| E189 | Exposed | 0.3 | 0.4 | 0.34 | −0.1 | −0.04 |
| M190 | Buried | 0.02 | 0.09 | 0.05 | −0.07 | −0.03 |
| A191 | Buried | 0 | 0 | 0 | 0 | 0 |
| R192 | Exposed | 0.58 | 0.54 | 0.54 | 0.04 | 0.04 |
| A193 | Exposed | 0.48 | 0.48 | 0.45 | 0 | 0.03 |
| N194 | Buried | 0.09 | 0.1 | 0.12 | −0.01 | −0.03 |
| H195 | Exposed | 0.89 | 0.9 | 0.91 | −0.01 | −0.02 |
| Y196 | Partial | 0.24 | 0.15 | 0.15 | 0.09 | 0.09 |
| E197 | Exposed | 0.7 | 0.7 | 0.64 | 0 | 0.06 |
| D198 | Buried | 0.05 | 0.01 | 0.01 | 0.04 | 0.04 |
| Y199 | Buried | 0.03 | 0.04 | 0.04 | −0.01 | −0.01 |
| G200 | Buried | 0 | 0 | 0 | 0 | 0 |
| D201 | Buried | 0.02 | 0.01 | 0.03 | 0.01 | −0.01 |
| Y202 | Partial | 0.18 | 0.42 | 0.22 | −0.24 | −0.04 |
| W203 | Buried | 0.13 | 0.11 | 0.12 | 0.02 | 0.01 |
| R204 | Buried | 0.02 | 0.02 | 0.03 | 0 | −0.01 |
| G205 | Buried | 0.1 | 0.19 | 0.16 | −0.09 | −0.06 |
| D206 | Partial | 0.41 | 0.38 | 0.37 | 0.03 | 0.04 |
| Y207 | Buried | 0 | 0 | 0 | 0 | 0 |
| E208 | Exposed | 0.26 | 0.24 | 0.24 | 0.02 | 0.02 |
| V209 | Buried | 0.12 | 0.11 | 0.1 | 0.01 | 0.02 |
| N210 | Exposed | 0.48 | 0.61 | 0.68 | −0.13 | −0.2 |
| G211 | Exposed | 0.82 | 0.9 | 0.72 | −0.08 | 0.1 |
| V212 | Partial | 0.28 | 0.47 | 0.13 | −0.19 | 0.15 |
| D213 | Exposed | 1.11 | 1.01 | 1.07 | 0.1 | 0.04 |
| G214 | Exposed | 0.81 | 0.89 | 0.85 | −0.08 | −0.04 |
| Y215 | Exposed | 0.23 | 0.24 | 0.24 | −0.01 | −0.01 |
| D216 | Exposed | 0.48 | 0.47 | 0.51 | 0.01 | −0.03 |
| Y217 | Buried | 0.03 | 0.1 | 0.05 | −0.07 | −0.02 |
| S218 | Exposed | 0.63 | 0.58 | 0.69 | 0.05 | −0.06 |
| R219 | Exposed | 0.23 | 0.2 | 0.27 | 0.03 | −0.04 |
| G220 | Exposed | 0.64 | 0.77 | 0.6 | −0.13 | 0.04 |
| Q221 | Exposed | 0.37 | 0.37 | 0.49 | 0 | −0.12 |
| L222 | Buried | 0.01 | 0.01 | 0.01 | 0 | 0 |
| I223 | Partial | 0.14 | 0.18 | 0.25 | −0.04 | −0.11 |
| E224 | Exposed | 0.69 | 0.64 | 0.68 | 0.05 | 0.01 |
| D225 | Exposed | 0.24 | 0.18 | 0.25 | 0.06 | −0.01 |
| V226 | Buried | 0 | 0.01 | 0 | −0.01 | 0 |
| E227 | Exposed | 0.33 | 0.39 | 0.37 | −0.06 | −0.04 |
| H228 | Exposed | 0.75 | 0.7 | 0.67 | 0.05 | 0.08 |
| T229 | Buried | 0.04 | 0.05 | 0.04 | −0.01 | 0 |
| F230 | Buried | 0.02 | 0.03 | 0.05 | −0.01 | −0.03 |
| E231 | Exposed | 0.58 | 0.64 | 0.56 | −0.06 | 0.02 |

TABLE 4-continued

| Amino Acid in | | Fractional SASA | | | Differences in Fractional ASA | |
|---|---|---|---|---|---|---|
| Human ACE2 | Disposition | 1R42 | 1R4L | 6M17 | 1R42 − IR4L | 1R42 − 6M17 |
| E232 | Exposed | 0.39 | 0.32 | 0.34 | 0.07 | 0.05 |
| I233 | Buried | 0 | 0 | 0 | 0 | 0 |
| K234 | Exposed | 0.39 | 0.44 | 0.49 | −0.05 | −0.1 |
| P235 | Exposed | 0.51 | 0.49 | 0.55 | 0.02 | −0.04 |
| L236 | Buried | 0.02 | 0.02 | 0.02 | 0 | 0 |
| Y237 | Buried | 0.01 | 0.01 | 0.01 | 0 | 0 |
| E238 | Exposed | 0.32 | 0.32 | 0.3 | 0 | 0.02 |
| H239 | Partial | 0.15 | 0.17 | 0.17 | −0.02 | −0.02 |
| L240 | Buried | 0 | 0 | 0 | 0 | 0 |
| H241 | Buried | 0 | 0 | 0 | 0 | 0 |
| A242 | Buried | 0 | 0 | 0 | 0 | 0 |
| Y243 | Buried | 0.05 | 0.06 | 0.04 | −0.01 | 0.01 |
| V244 | Buried | 0 | 0 | 0 | 0 | 0 |
| R245 | Buried | 0.01 | 0 | 0.03 | 0.01 | −0.02 |
| A246 | Exposed | 0.36 | 0.28 | 0.44 | 0.08 | −0.08 |
| K247 | Exposed | 0.34 | 0.36 | 0.33 | −0.02 | 0.01 |
| L248 | Buried | 0 | 0 | 0 | 0 | 0 |
| M249 | Partial | 0.26 | 0.28 | 0.34 | −0.02 | −0.08 |
| N250 | Exposed | 0.79 | 0.8 | 0.74 | −0.01 | 0.05 |
| A251 | Partial | 0.28 | 0.36 | 0.23 | −0.08 | 0.05 |
| Y252 | Buried | 0.03 | 0.03 | 0.05 | 0 | −0.02 |
| P253 | Exposed | 0.66 | 0.71 | 0.7 | −0.05 | −0.04 |
| S254 | Exposed | 0.98 | 0.9 | 1 | 0.08 | −0.02 |
| Y255 | Exposed | 0.42 | 0.41 | 0.44 | 0.01 | −0.02 |
| I256 | Buried | 0.01 | 0.01 | 0 | 0 | 0.01 |
| S257 | Partial | 0.19 | 0.2 | 0.16 | −0.01 | 0.03 |
| P258 | Exposed | 0.66 | 0.64 | 0.57 | 0.02 | 0.09 |
| I259 | Exposed | 0.5 | 0.57 | 0.61 | −0.07 | −0.11 |
| G260 | Buried | 0 | 0 | 0 | 0 | 0 |
| C261 | Buried | 0 | 0 | 0 | 0 | 0 |
| L262 | Buried | 0 | 0 | 0 | 0 | 0 |
| P263 | Buried | 0 | 0 | 0 | 0 | 0 |
| A264 | Buried | 0.02 | 0.03 | 0.05 | −0.01 | −0.03 |
| H265 | Buried | 0 | 0 | 0 | 0 | 0 |
| L266 | Buried | 0 | 0 | 0 | 0 | 0 |
| L267 | Buried | 0.01 | 0.01 | 0.02 | 0 | −0.01 |
| G268 | Buried | 0.05 | 0.04 | 0.05 | 0.01 | 0 |
| D269 | Partial | 0.21 | 0.23 | 0.21 | −0.02 | 0 |
| M270 | Buried | 0 | 0 | 0 | 0 | 0 |
| W271 | Partial | 0.14 | 0.16 | 0.16 | −0.02 | −0.02 |
| G272 | Buried | 0 | 0 | 0.02 | 0 | −0.02 |
| R273 | Partial | 0.16 | 0.1 | 0.16 | 0.06 | 0 |
| F274 | Partial | 0.35 | 0.28 | 0.36 | 0.07 | −0.01 |
| W275 | Buried | 0.01 | 0 | 0.01 | 0.01 | 0 |
| T276 | Exposed | 0.4 | 0.1 | 0.42 | 0.3 | −0.02 |
| N277 | Exposed | 0.39 | 0.24 | 0.4 | 0.15 | −0.01 |
| L278 | Buried | 0.02 | 0.02 | 0.04 | 0 | −0.02 |
| Y279 | Partial | 0.19 | 0.02 | 0.17 | 0.17 | 0.02 |
| S280 | Exposed | 0.84 | 0.75 | 0.79 | 0.09 | 0.05 |
| L281 | Partial | 0.17 | 0.17 | 0.2 | 0 | −0.03 |
| T282 | Buried | 0.01 | 0 | 0 | 0.01 | 0.01 |
| V283 | Partial | 0.21 | 0.18 | 0.25 | 0.03 | −0.04 |
| P284 | Partial | 0.01 | 0.02 | 0.01 | −0.01 | 0 |
| F285 | Partial | 0.25 | 0.26 | 0.23 | −0.01 | 0.02 |
| G286 | Exposed | 0.48 | 0.38 | 0.48 | 0.1 | 0 |
| Q287 | Exposed | 0.77 | 0.72 | 0.77 | 0.05 | 0 |
| K288 | Exposed | 0.29 | 0.25 | 0.36 | 0.04 | −0.07 |
| P289 | Exposed | 0.7 | 0.48 | 0.89 | 0.22 | −0.19 |
| N290 | Exposed | 0.56 | 0.5 | 0.23 | 0.06 | 0.33 |
| I291 | Partial | 0.2 | 0.04 | 0.23 | 0.16 | −0.03 |
| D292 | Exposed | 0.42 | 0.19 | 0.63 | 0.23 | −0.21 |
| V293 | Buried | 0.04 | 0.02 | 0.04 | 0.02 | 0 |
| T294 | Exposed | 0.25 | 0.26 | 0.34 | −0.01 | −0.09 |
| D295 | Exposed | 0.82 | 0.65 | 0.78 | 0.17 | 0.04 |
| A296 | Partial | 0.41 | 0.4 | 0.32 | 0.01 | 0.09 |
| M297 | Buried | 0 | 0 | 0 | 0 | 0 |
| V298 | Exposed | 0.67 | 0.67 | 0.53 | 0 | 0.14 |
| D299 | Exposed | 0.92 | 0.89 | 0.72 | 0.03 | 0.2 |
| Q300 | Exposed | 0.43 | 0.48 | 0.54 | −0.05 | −0.11 |
| A301 | Exposed | 0.9 | 0.87 | 0.94 | 0.03 | −0.04 |
| W302 | Buried | 0 | 0 | 0.04 | 0 | −0.04 |
| D303 | Exposed | 0.63 | 0.66 | 0.66 | −0.03 | −0.03 |
| A304 | Buried | 0.05 | 0.17 | 0.28 | −0.12 | −0.23 |
| Q305 | Exposed | 0.64 | 0.65 | 0.49 | −0.01 | 0.15 |
| R306 | Exposed | 0.43 | 0.37 | 0.46 | 0.06 | −0.03 |
| I307 | Buried | 0 | 0 | 0 | 0 | 0 |

TABLE 4-continued

| Amino Acid in | | Fractional SASA | | | Differences in Fractional ASA | |
|---|---|---|---|---|---|---|
| Human ACE2 | Disposition | 1R42 | 1R4L | 6M17 | 1R42 – IR4L | 1R42 – 6M17 |
| F308 | Buried | 0 | 0 | 0 | 0 | 0 |
| K309 | Exposed | 0.53 | 0.52 | 0.6 | 0.01 | −0.07 |
| E310 | Partial | 0.12 | 0.18 | 0.1 | −0.06 | 0.02 |
| A311 | Buried | 0 | 0 | 0 | 0 | 0 |
| E312 | Partial | 0.09 | 0.09 | 0.05 | 0 | 0.04 |
| K313 | Exposed | 0.78 | 0.59 | 0.65 | 0.19 | 0.13 |
| F314 | Buried | 0.03 | 0.02 | 0.03 | 0.01 | 0 |
| F315 | Buried | 0 | 0.01 | 0 | −0.01 | 0 |
| V316 | Exposed | 0.44 | 0.33 | 0.46 | 0.11 | −0.02 |
| S317 | Partial | 0.29 | 0.11 | 0.27 | 0.18 | 0.02 |
| V318 | Buried | 0 | 0.01 | 0.01 | −0.01 | −0.01 |
| G319 | Exposed | 0.49 | 0.45 | 0.48 | 0.04 | 0.01 |
| L320 | Buried | 0.02 | 0.02 | 0.02 | 0 | 0 |
| P321 | Exposed | 0.52 | 0.49 | 0.58 | 0.03 | −0.06 |
| N322 | Exposed | 0.63 | 0.59 | 0.62 | 0.04 | 0.01 |
| M323 | Buried | 0 | 0 | 0 | 0 | 0 |
| T324 | Exposed | 0.43 | 0.45 | 0.35 | −0.02 | 0.08 |
| Q325 | Exposed | 0.94 | 1 | 0.84 | −0.06 | 0.1 |
| G326 | Exposed | 0.25 | 0.71 | 0.49 | −0.46 | −0.24 |
| F327 | Buried | 0 | 0 | 0 | 0 | 0 |
| W328 | Partial | 0.17 | 0.15 | 0.18 | 0.02 | −0.01 |
| E329 | Exposed | 0.74 | 0.82 | 0.65 | −0.08 | 0.09 |
| N330 | Exposed | 0.4 | 0.39 | 0.44 | 0.01 | −0.04 |
| S331 | Buried | 0 | 0.01 | 0.01 | −0.01 | −0.01 |
| M332 | Partial | 0.19 | 0.21 | 0.18 | −0.02 | 0.01 |
| L333 | Buried | 0.03 | 0.1 | 0.08 | −0.07 | −0.05 |
| T334 | Exposed | 0.63 | 0.58 | 0.4 | 0.05 | 0.23 |
| D335 | Exposed | 0.45 | 0.29 | 0.46 | 0.16 | −0.01 |
| P336 | Exposed | 0.22 | 0.24 | 0.28 | −0.02 | −0.06 |
| G337 | Exposed | 0.68 | 0.7 | 1.06 | −0.02 | −0.38 |
| N338 | Exposed | 0.92 | 1.05 | 0.59 | −0.13 | 0.33 |
| V339 | Exposed | 0.97 | 1 | 1.1 | −0.03 | −0.13 |
| Q340 | Exposed | 0.44 | 0.32 | 0.26 | 0.12 | 0.18 |
| K341 | Exposed | 0.68 | 0.58 | 0.8 | 0.1 | −0.12 |
| A342 | Buried | 0 | 0 | 0.01 | 0 | −0.01 |
| V343 | Exposed | 0.29 | 0.03 | 0.53 | 0.26 | −0.24 |
| C344 | Exposed | 0.41 | 0.12 | 0.38 | 0.29 | 0.03 |
| H345 | Exposed | 0.82 | 0.29 | 0.7 | 0.53 | 0.12 |
| P346 | Exposed | 0.39 | 0.25 | 0.4 | 0.14 | −0.01 |
| T347 | Partial | 0.46 | 0.32 | 0.51 | 0.14 | −0.05 |
| A348 | Buried | 0.05 | 0 | 0.03 | 0.05 | 0.02 |
| W349 | Partial | 0.19 | 0.16 | 0.2 | 0.03 | −0.01 |
| D350 | Partial | 0.26 | 0.28 | 0.35 | −0.02 | −0.09 |
| L351 | Buried | 0 | 0 | 0.01 | 0 | −0.01 |
| G352 | Buried | 0.07 | 0.28 | 0.27 | −0.21 | −0.2 |
| K353 | Exposed | 0.84 | 0.67 | 0.53 | 0.17 | 0.31 |
| G354 | Exposed | 0.54 | 0.64 | 0.49 | −0.1 | 0.05 |
| D355 | Partial | 0.17 | 0.18 | 0.19 | −0.01 | −0.02 |
| F356 | Buried | 0.05 | 0.05 | 0.06 | 0 | −0.01 |
| R357 | Partial | 0.09 | 0.1 | 0.11 | −0.01 | −0.02 |
| I358 | Buried | 0 | 0 | 0 | 0 | 0 |
| L359 | Buried | 0 | 0 | 0.01 | 0 | −0.01 |
| M360 | Buried | 0.01 | 0.01 | 0.02 | 0 | −0.01 |
| C361 | Partial | 0.06 | 0.03 | 0.07 | 0.03 | −0.01 |
| T362 | Buried | 0 | 0 | 0 | 0 | 0 |
| K363 | Exposed | 0.81 | 0.45 | 0.61 | 0.36 | 0.2 |
| V364 | Partial | 0.31 | 0.3 | 0.29 | 0.01 | 0.02 |
| T365 | Exposed | 0.36 | 0.36 | 0.39 | 0 | −0.03 |
| M366 | Partial | 0.18 | 0.04 | 0.16 | 0.14 | 0.02 |
| D367 | Exposed | 0.73 | 0.46 | 0.8 | 0.27 | −0.07 |
| D368 | Partial | 0.19 | 0.13 | 0.24 | 0.06 | −0.05 |
| F369 | Buried | 0 | 0 | 0.01 | 0 | −0.01 |
| L370 | Partial | 0.15 | 0.21 | 0.21 | −0.06 | −0.06 |
| T371 | Exposed | 0.34 | 0.36 | 0.25 | −0.02 | 0.09 |
| A372 | Buried | 0 | 0 | 0 | 0 | 0 |
| H373 | Buried | 0 | 0.01 | 0 | −0.01 | 0 |
| H374 | Partial | 0.15 | 0.1 | 0.17 | 0.05 | −0.02 |
| E375 | Partial | 0.11 | 0.06 | 0.05 | 0.05 | 0.06 |
| M376 | Buried | 0 | 0 | 0 | 0 | 0 |
| G377 | Buried | 0 | 0 | 0 | 0 | 0 |
| H378 | Partial | 0.09 | 0.16 | 0.09 | −0.07 | 0 |
| I379 | Buried | 0 | 0 | 0.01 | 0 | −0.01 |
| Q380 | Buried | 0.01 | 0.01 | 0.01 | 0 | 0 |
| Y381 | Buried | 0 | 0.01 | 0.01 | −0.01 | −0.01 |
| D382 | Partial | 0.07 | 0.07 | 0.07 | 0 | 0 |
| M383 | Partial | 0.11 | 0.15 | 0.14 | −0.04 | −0.03 |

TABLE 4-continued

| Amino Acid in | | Fractional SASA | | | Differences in Fractional ASA | |
| --- | --- | --- | --- | --- | --- | --- |
| Human ACE2 | Disposition | 1R42 | 1R4L | 6M17 | 1R42 − IR4L | 1R42 − 6M17 |
| A384 | Buried | 0.08 | 0.09 | 0.08 | −0.01 | 0 |
| Y385 | Buried | 0.03 | 0.04 | 0.03 | −0.01 | 0 |
| A386 | Exposed | 0.34 | 0.43 | 0.38 | −0.09 | −0.04 |
| A387 | Exposed | 0.99 | 1.05 | 0.91 | −0.06 | 0.08 |
| Q388 | Exposed | 0.17 | 0.21 | 0.22 | −0.04 | −0.05 |
| P389 | Partial | 0.35 | 0.39 | 0.37 | −0.04 | −0.02 |
| F390 | Partial | 0.13 | 0.12 | 0.13 | 0.01 | 0 |
| L391 | Partial | 0.14 | 0.26 | 0.15 | −0.12 | −0.01 |
| L392 | Buried | 0.02 | 0.08 | 0.01 | −0.06 | 0.01 |
| R393 | Partial | 0.15 | 0.21 | 0.26 | −0.06 | −0.11 |
| N394 | Exposed | 0.56 | 0.65 | 0.72 | −0.09 | −0.16 |
| G395 | Buried | 0.03 | 0 | 0.03 | 0.03 | 0 |
| A396 | Buried | 0 | 0.01 | 0.03 | −0.01 | −0.03 |
| N397 | Buried | 0.02 | 0.01 | 0.01 | 0.01 | 0.01 |
| E398 | Partial | 0.18 | 0.13 | 0.22 | 0.05 | −0.04 |
| G399 | Buried | 0.01 | 0 | 0.02 | 0.01 | −0.01 |
| F400 | Buried | 0 | 0.03 | 0 | −0.03 | 0 |
| H401 | Partial | 0.2 | 0.18 | 0.32 | 0.02 | −0.12 |
| E402 | Exposed | 0.43 | 0.04 | 0.45 | 0.39 | −0.02 |
| A403 | Buried | 0 | 0.01 | 0 | −0.01 | 0 |
| V404 | Buried | 0 | 0.04 | 0.01 | −0.04 | −0.01 |
| G405 | Buried | 0 | 0 | 0 | 0 | 0 |
| E406 | Exposed | 0.32 | 0.16 | 0.26 | 0.16 | 0.06 |
| I407 | Buried | 0 | 0.01 | 0 | −0.01 | 0 |
| M408 | Buried | 0 | 0 | 0.01 | 0 | −0.01 |
| S409 | Exposed | 0.22 | 0.07 | 0.21 | 0.15 | 0.01 |
| L410 | Partial | 0.13 | 0.02 | 0.16 | 0.11 | −0.03 |
| S411 | Buried | 0 | 0 | 0 | 0 | 0 |
| A412 | Buried | 0 | 0 | 0 | 0 | 0 |
| A413 | Exposed | 0.18 | 0.02 | 0.17 | 0.16 | 0.01 |
| T414 | Buried | 0.06 | 0.01 | 0.05 | 0.05 | 0.01 |
| P415 | Buried | 0.16 | 0.14 | 0.2 | 0.02 | −0.04 |
| K416 | Exposed | 0.5 | 0.55 | 0.55 | −0.05 | −0.05 |
| H417 | Buried | 0.03 | 0.12 | 0.05 | −0.09 | −0.02 |
| L418 | Buried | 0 | 0 | 0 | 0 | 0 |
| K419 | Exposed | 0.36 | 0.33 | 0.33 | 0.03 | 0.03 |
| S420 | Exposed | 0.78 | 0.69 | 0.69 | 0.09 | 0.09 |
| I421 | Partial | 0.17 | 0.15 | 0.09 | 0.02 | 0.08 |
| G422 | Exposed | 0.69 | 0.41 | 0.81 | 0.28 | −0.12 |
| L423 | Buried | 0 | 0.01 | 0.03 | −0.01 | −0.03 |
| L424 | Partial | 0.13 | 0.13 | 0.13 | 0 | 0 |
| S425 | Exposed | 0.62 | 0.81 | 0.62 | −0.19 | 0 |
| P426 | Exposed | 0.77 | 0.78 | 0.86 | −0.01 | −0.09 |
| D427 | Exposed | 0.92 | 0.15 | 0.86 | 0.77 | 0.06 |
| F428 | Partial | 0.24 | 0.26 | 0.3 | −0.02 | −0.06 |
| Q429 | Exposed | 0.86 | 0.53 | 0.91 | 0.33 | −0.05 |
| E430 | Exposed | 0.23 | 0.3 | 0.24 | −0.07 | −0.01 |
| D431 | Exposed | 0.25 | 0.36 | 0.43 | −0.11 | −0.18 |
| N432 | Exposed | 0.88 | 0.93 | 0.89 | −0.05 | −0.01 |
| E433 | Exposed | 0.31 | 0.3 | 0.32 | 0.01 | −0.01 |
| T434 | Buried | 0.07 | 0.11 | 0.15 | −0.04 | −0.08 |
| E435 | Partial | 0.18 | 0.13 | 0.17 | 0.05 | 0.01 |
| I436 | Partial | 0.1 | 0.15 | 0.11 | −0.05 | −0.01 |
| N437 | Buried | 0.07 | 0.01 | 0 | 0.06 | 0.07 |
| F438 | Partial | 0.35 | 0.01 | 0.3 | 0.34 | 0.05 |
| L439 | Buried | 0 | 0 | 0 | 0 | 0 |
| L440 | Buried | 0 | 0 | 0 | 0 | 0 |
| K441 | Exposed | 0.37 | 0.09 | 0.48 | 0.28 | −0.11 |
| Q442 | Partial | 0.19 | 0.07 | 0.24 | 0.12 | −0.05 |
| A443 | Buried | 0 | 0 | 0.01 | 0 | −0.01 |
| L444 | Buried | 0 | 0 | 0 | 0 | 0 |
| T445 | Exposed | 0.4 | 0.31 | 0.41 | 0.09 | −0.01 |
| I446 | Partial | 0.11 | 0.07 | 0.14 | 0.04 | −0.03 |
| V447 | Buried | 0 | 0 | 0 | 0 | 0 |
| G448 | Buried | 0 | 0 | 0 | 0 | 0 |
| T449 | Buried | 0.07 | 0.03 | 0.08 | 0.04 | −0.01 |
| L450 | Buried | 0 | 0 | 0 | 0 | 0 |
| P451 | Buried | 0 | 0 | 0 | 0 | 0 |
| F452 | Buried | 0.02 | 0.02 | 0.03 | 0 | −0.01 |
| T453 | Buried | 0 | 0 | 0.01 | 0 | −0.01 |
| Y454 | Partial | 0.07 | 0.08 | 0.07 | −0.01 | 0 |
| M455 | Buried | 0 | 0 | 0 | 0 | 0 |
| L456 | Buried | 0 | 0.01 | 0 | −0.01 | 0 |
| E457 | Buried | 0.01 | 0.01 | 0.01 | 0 | 0 |
| K458 | Exposed | 0.23 | 0.21 | 0.31 | 0.02 | −0.08 |
| W459 | Buried | 0 | 0 | 0 | 0 | 0 |

TABLE 4-continued

| Amino Acid in | | Fractional SASA | | | Differences in Fractional ASA | |
|---|---|---|---|---|---|---|
| Human ACE2 | Disposition | 1R42 | 1R4L | 6M17 | 1R42 − IR4L | 1R42 − 6M17 |
| R460 | Buried | 0 | 0 | 0 | 0 | 0 |
| W461 | Buried | 0.01 | 0.01 | 0.03 | 0 | −0.02 |
| M462 | Exposed | 0.21 | 0.14 | 0.2 | 0.07 | 0.01 |
| V463 | Buried | 0.01 | 0.02 | 0 | −0.01 | 0.01 |
| F464 | Buried | 0 | 0 | 0 | 0 | 0 |
| K465 | Exposed | 0.31 | 0.28 | 0.31 | 0.03 | 0 |
| G466 | Exposed | 0.63 | 0.63 | 0.54 | 0 | 0.09 |
| E467 | Exposed | 0.5 | 0.51 | 0.54 | −0.01 | −0.04 |
| I468 | Buried | 0.01 | 0 | 0.01 | 0.01 | 0 |
| P469 | Exposed | 0.54 | 0.57 | 0.55 | −0.03 | −0.01 |
| K470 | Exposed | 0.53 | 0.49 | 0.66 | 0.04 | −0.13 |
| D471 | Exposed | 0.76 | 0.74 | 0.73 | 0.02 | 0.03 |
| Q472 | Exposed | 0.42 | 0.31 | 0.38 | 0.11 | 0.04 |
| W473 | Buried | 0.02 | 0.01 | 0.04 | 0.01 | −0.02 |
| M474 | Buried | 0 | 0 | 0.01 | 0 | −0.01 |
| K475 | Exposed | 0.66 | 0.46 | 0.61 | 0.2 | 0.05 |
| K476 | Exposed | 0.34 | 0.36 | 0.31 | −0.02 | 0.03 |
| W477 | Buried | 0.04 | 0.03 | 0.05 | 0.01 | −0.01 |
| W478 | Buried | 0.06 | 0.04 | 0.05 | 0.02 | 0.01 |
| E479 | Exposed | 0.5 | 0.43 | 0.48 | 0.07 | 0.02 |
| M480 | Partial | 0.07 | 0.07 | 0.03 | 0 | 0.04 |
| K481 | Buried | 0.04 | 0.04 | 0.06 | 0 | −0.02 |
| R482 | Exposed | 0.16 | 0.21 | 0.15 | −0.05 | 0.01 |
| E483 | Exposed | 0.61 | 0.63 | 0.64 | −0.02 | −0.03 |
| I484 | Partial | 0.19 | 0.17 | 0.09 | 0.02 | 0.1 |
| V485 | Buried | 0.02 | 0.02 | 0.04 | 0 | −0.02 |
| G486 | Buried | 0 | 0 | 0 | 0 | 0 |
| V487 | Buried | 0.01 | 0 | 0.01 | 0.01 | 0 |
| V488 | Buried | 0 | 0 | 0 | 0 | 0 |
| E489 | Buried | 0.07 | 0.05 | 0.09 | 0.02 | −0.02 |
| P490 | Buried | 0 | 0.01 | 0.01 | −0.01 | −0.01 |
| V491 | Partial | 0.32 | 0.35 | 0.04 | −0.03 | 0.28 |
| P492 | Partial | 0.56 | 0.57 | 0.08 | −0.01 | 0.48 |
| H493 | Buried | 0.01 | 0 | 0 | 0.01 | 0.01 |
| D494 | Exposed | 0.76 | 0.75 | 0.7 | 0.01 | 0.06 |
| E495 | Partial | 0.27 | 0.3 | 0.29 | −0.03 | −0.02 |
| T496 | Exposed | 0.54 | 0.41 | 0.65 | 0.13 | −0.11 |
| Y497 | Partial | 0.1 | 0.09 | 0.07 | 0.01 | 0.03 |
| C498 | Buried | 0 | 0 | 0.01 | 0 | −0.01 |
| D499 | Buried | 0.01 | 0.02 | 0.02 | −0.01 | −0.01 |
| P500 | Buried | 0 | 0.01 | 0.01 | −0.01 | −0.01 |
| A501 | Buried | 0 | 0 | 0 | 0 | 0 |
| S502 | Buried | 0 | 0 | 0 | 0 | 0 |
| L503 | Buried | 0.03 | 0.02 | 0.03 | 0.01 | 0 |
| F504 | Exposed | 0.45 | 0.06 | 0.44 | 0.39 | 0.01 |
| H505 | Partial | 0.11 | 0.03 | 0.13 | 0.08 | −0.02 |
| V506 | Buried | 0 | 0 | 0 | 0 | 0 |
| S507 | Buried | 0 | 0 | 0 | 0 | 0 |
| N508 | Partial | 0.13 | 0.14 | 0.18 | −0.01 | −0.05 |
| D509 | Exposed | 0.16 | 0.26 | 0.16 | −0.1 | 0 |
| Y510 | Exposed | 0.6 | 0.55 | 0.51 | 0.05 | 0.09 |
| S511 | Partial | 0.12 | 0.05 | 0.11 | 0.07 | 0.01 |
| F512 | Buried | 0 | 0 | 0 | 0 | 0 |
| I513 | Buried | 0.03 | 0.01 | 0.02 | 0.02 | 0.01 |
| R514 | Exposed | 0.38 | 0.17 | 0.34 | 0.21 | 0.04 |
| Y515 | Partial | 0.27 | 0.1 | 0.26 | 0.17 | 0.01 |
| Y516 | Buried | 0 | 0 | 0 | 0 | 0 |
| T517 | Buried | 0 | 0.01 | 0 | −0.01 | 0 |
| R518 | Exposed | 0.18 | 0.09 | 0.16 | 0.09 | 0.02 |
| T519 | Buried | 0.02 | 0.02 | 0.01 | 0 | 0.01 |
| L520 | Buried | 0 | 0 | 0 | 0 | 0 |
| Y521 | Buried | 0 | 0.01 | 0 | −0.01 | 0 |
| Q522 | Buried | 0.01 | 0.01 | 0.01 | 0 | 0 |
| F523 | Buried | 0 | 0 | 0 | 0 | 0 |
| Q524 | Buried | 0.01 | 0.05 | 0 | −0.04 | 0.01 |
| F525 | Buried | 0 | 0.02 | 0 | −0.02 | 0 |
| Q526 | Buried | 0.01 | 0 | 0.03 | 0.01 | −0.02 |
| E527 | Exposed | 0.25 | 0.44 | 0.25 | −0.19 | 0 |
| A528 | Partial | 0.14 | 0.16 | 0.14 | −0.02 | 0 |
| L529 | Buried | 0 | 0 | 0 | 0 | 0 |
| C530 | Buried | 0.02 | 0.05 | 0.03 | −0.03 | −0.01 |
| Q531 | Exposed | 0.77 | 0.79 | 0.8 | −0.02 | −0.03 |
| A532 | Exposed | 0.18 | 0.3 | 0.13 | −0.12 | 0.05 |
| A533 | Partial | 0.07 | 0.16 | 0.12 | −0.09 | −0.05 |
| K534 | Exposed | 0.89 | 0.82 | 0.81 | 0.07 | 0.08 |
| H535 | Buried | 0.12 | 0.18 | 0.13 | −0.06 | −0.01 |

TABLE 4-continued

| Amino Acid in | | Fractional SASA | | | Differences in Fractional ASA | |
|---|---|---|---|---|---|---|
| Human ACE2 | Disposition | 1R42 | 1R4L | 6M17 | 1R42 − IR4L | 1R42 − 6M17 |
| E536 | Exposed | 0.88 | 0.76 | 0.79 | 0.12 | 0.09 |
| G537 | Exposed | 0.54 | 0.44 | 0.41 | 0.1 | 0.13 |
| P538 | Exposed | 0.51 | 0.53 | 0.43 | −0.02 | 0.08 |
| L539 | Buried | 0.08 | 0.1 | 0.1 | −0.02 | −0.02 |
| H540 | Buried | 0.03 | 0.03 | 0.04 | 0 | −0.01 |
| K541 | Exposed | 0.28 | 0.31 | 0.43 | −0.03 | −0.15 |
| C542 | Buried | 0 | 0.01 | 0.01 | −0.01 | −0.01 |
| D543 | Buried | 0.08 | 0.43 | 0.05 | −0.35 | 0.03 |
| I544 | Buried | 0 | 0.03 | 0.01 | −0.03 | −0.01 |
| S545 | Partial | 0.19 | 0.22 | 0.21 | −0.03 | −0.02 |
| N546 | Exposed | 0.79 | 0.73 | 0.86 | 0.06 | −0.07 |
| S547 | Partial | 0.17 | 0.19 | 0.2 | −0.02 | −0.03 |
| T548 | Exposed | 0.73 | 0.59 | 0.84 | 0.14 | −0.11 |
| E549 | Exposed | 0.7 | 0.71 | 0.63 | −0.01 | 0.07 |
| A550 | Buried | 0 | 0 | 0 | 0 | 0 |
| G551 | Buried | 0 | 0.02 | 0.01 | −0.02 | −0.01 |
| Q552 | Exposed | 0.61 | 0.62 | 0.67 | −0.01 | −0.06 |
| K553 | Exposed | 0.36 | 0.36 | 0.35 | 0 | 0.01 |
| L554 | Buried | 0 | 0.05 | 0 | −0.05 | 0 |
| F555 | Exposed | 0.34 | 0.35 | 0.33 | −0.01 | 0.01 |
| N556 | Exposed | 0.41 | 0.52 | 0.43 | −0.11 | −0.02 |
| M557 | Buried | 0 | 0.04 | 0.01 | −0.04 | −0.01 |
| L558 | Buried | 0 | 0.02 | 0 | −0.02 | 0 |
| R559 | Exposed | 0.51 | 0.48 | 0.56 | 0.03 | −0.05 |
| L560 | Buried | 0.07 | 0.29 | 0.15 | −0.22 | −0.08 |
| G561 | Buried | 0 | 0 | 0 | 0 | 0 |
| K562 | Exposed | 0.37 | 0.32 | 0.31 | 0.05 | 0.06 |
| S563 | Partial | 0.12 | 0.13 | 0.16 | −0.01 | −0.04 |
| E564 | Exposed | 0.35 | 0.31 | 0.35 | 0.04 | 0 |
| P565 | Partial | 0.15 | 0.21 | 0.12 | −0.06 | 0.03 |
| W566 | Buried | 0.03 | 0.02 | 0.02 | 0.01 | 0.01 |
| T567 | Buried | 0.03 | 0.02 | 0.02 | 0.01 | 0.01 |
| L568 | Exposed | 0.2 | 0.25 | 0.22 | −0.05 | −0.02 |
| A569 | Buried | 0 | 0.04 | 0.01 | −0.04 | −0.01 |
| L570 | Buried | 0 | 0 | 0 | 0 | 0 |
| E571 | Exposed | 0.29 | 0.36 | 0.3 | −0.07 | −0.01 |
| N572 | Exposed | 0.3 | 0.63 | 0.24 | −0.33 | 0.06 |
| V573 | Buried | 0 | 0.06 | 0 | −0.06 | 0 |
| V574 | Buried | 0.08 | 0.09 | 0.15 | −0.01 | −0.07 |
| G575 | Exposed | 0.66 | 1.02 | 0.56 | −0.36 | 0.1 |
| A576 | Exposed | 0.58 | 0.53 | 0.41 | 0.05 | 0.17 |
| K577 | Exposed | 0.48 | 0.45 | 0.53 | 0.03 | −0.05 |
| N578 | Partial | 0.35 | 0.36 | 0.57 | −0.01 | −0.22 |
| M579 | Buried | 0.01 | 0.03 | 0.01 | −0.02 | 0 |
| N580 | Partial | 0.26 | 0.32 | 0.42 | −0.06 | −0.16 |
| V581 | Buried | 0 | 0.02 | 0 | −0.02 | 0 |
| R582 | Exposed | 0.71 | 0.59 | 0.54 | 0.12 | 0.17 |
| P583 | Buried | 0.08 | 0.03 | 0.07 | 0.05 | 0.01 |
| L584 | Buried | 0 | 0 | 0 | 0 | 0 |
| L585 | Partial | 0.18 | 0.17 | 0.09 | 0.01 | 0.09 |
| N586 | Exposed | 0.43 | 0.47 | 0.37 | −0.04 | 0.06 |
| Y587 | Buried | 0.01 | 0 | 0.02 | 0.01 | −0.01 |
| F588 | Buried | 0 | 0 | 0 | 0 | 0 |
| E589 | Exposed | 0.42 | 0.43 | 0.41 | −0.01 | 0.01 |
| P590 | Partial | 0.29 | 0.33 | 0.34 | −0.04 | −0.05 |
| L591 | Buried | 0 | 0 | 0 | 0 | 0 |
| F592 | Partial | 0.19 | 0.15 | 0.18 | 0.04 | 0.01 |
| T593 | Exposed | 0.58 | 0.62 | 0.79 | −0.04 | −0.21 |
| W594 | Partial | 0.2 | 0.17 | 0.21 | 0.03 | −0.01 |
| L595 | Buried | 0 | 0 | 0 | 0 | 0 |
| K596 | Exposed | 0.48 | 0.46 | 0.5 | 0.02 | −0.02 |
| D597 | Exposed | 0.74 | 0.64 | 0.62 | 0.1 | 0.12 |
| Q598 | Exposed | 0.42 | 0.44 | 0.44 | −0.02 | −0.02 |
| N599 | Buried | 0.02 | 0.02 | 0.01 | 0 | 0.01 |
| K600 | Exposed | 0.84 | 0.72 | 0.69 | 0.12 | 0.15 |
| N601 | Exposed | 0.86 | 0.76 | 0.96 | 0.1 | −0.1 |
| S602 | Partial | 0.34 | 0.29 | 0.34 | 0.05 | 0 |
| F603 | Partial | 0.53 | 0.51 | 0.53 | 0.02 | 0 |
| V604 | Partial | 0.24 | 0.24 | 0.23 | 0 | 0.01 |
| G605 | Exposed | 0.21 | 0.21 | 0.26 | 0 | −0.05 |
| W606 | Buried | 0.09 | 0.11 | 0.1 | −0.02 | −0.01 |
| S607 | Exposed | 0.36 | 0.29 | 0.42 | 0.07 | −0.06 |
| T608 | Exposed | 0.3 | 0.53 | 0.48 | −0.23 | −0.18 |
| D609 | Exposed | 0.93 | 0.86 | 0.9 | 0.07 | 0.03 |
| W610 | Partial | 0.25 | 0.23 | 0.32 | 0.02 | −0.07 |
| S611 | Buried | 0.04 | 0.11 | 0.06 | −0.07 | −0.02 |

TABLE 4-continued

| Amino Acid in | | Fractional SASA | | | Differences in Fractional ASA | |
|---|---|---|---|---|---|---|
| Human ACE2 | Disposition | 1R42 | 1R4L | 6M17 | 1R42 – IR4L | 1R42 – 6M17 |
| P612 | Buried | 0.09 | 0.03 | 0.09 | 0.06 | 0 |
| Y613 | Exposed | 0.38 | 0.31 | 0.06 | 0.07 | 0.32 |
| A614 | Exposed | 0.51 | 0.64 | 0.35 | −0.13 | 0.16 |
| D615 | Exposed | 1.23 | 1.2 | 0.81 | 0.03 | 0.42 |
| Q616 | Exposed | | | 0.32 | | |
| S617 | Partial | | | 0.04 | | |
| I618 | Buried | | | 0 | | |
| K619 | Exposed | | | 0.46 | | |
| V620 | Buried | | | 0 | | |
| R621 | Exposed | | | 0.32 | | |
| I622 | Buried | | | 0 | | |
| S623 | Exposed | | | 0.28 | | |
| L624 | Buried | | | 0.01 | | |
| K625 | Exposed | | | 0.71 | | |
| S626 | Exposed | | | 0.72 | | |
| A627 | Buried | | | 0.08 | | |
| L628 | Partial | | | 0.19 | | |
| G629 | Exposed | | | 0.4 | | |
| D630 | Exposed | | | 1.1 | | |
| K631 | Exposed | | | 0.92 | | |
| A632 | Buried | | | 0 | | |
| Y633 | Partial | | | 0.33 | | |
| E634 | Exposed | | | 0.73 | | |
| W635 | Buried | | | 0.04 | | |
| N636 | Partial | | | 0.46 | | |
| D637 | Exposed | | | 0.89 | | |
| N638 | Partial | | | 0.76 | | |
| E639 | Buried | | | 0.22 | | |
| M640 | Buried | | | 0.06 | | |
| Y641 | Buried | | | 0.59 | | |
| L642 | Buried | | | 0.48 | | |
| F643 | Buried | | | 0 | | |
| R644 | Partial | | | 0.24 | | |
| S645 | Buried | | | 0.35 | | |
| S646 | Buried | | | 0.14 | | |
| V647 | Buried | | | 0 | | |
| A648 | Buried | | | 0.06 | | |
| Y649 | Buried | | | 0.4 | | |
| A650 | Buried | | | 0 | | |
| M651 | Buried | | | 0 | | |
| R652 | Partial | | | 0.44 | | |
| Q653 | Buried | | | 0.26 | | |
| Y654 | Buried | | | 0.06 | | |
| F655 | Partial | | | 0.12 | | |
| L656 | Exposed | | | 0.53 | | |
| K657 | Exposed | | | 0.57 | | |
| V658 | Exposed | | | 0.46 | | |
| K659 | Exposed | | | 0.45 | | |
| N660 | Exposed | | | 0.79 | | |
| Q661 | Exposed | | | 0.61 | | |
| M662 | Exposed | | | 0.73 | | |
| I663 | Partial | | | 0.26 | | |
| L664 | Exposed | | | 0.6 | | |
| F665 | Buried | | | 0 | | |
| G666 | Exposed | | | 0.36 | | |
| E667 | Exposed | | | 0.31 | | |
| E668 | Exposed | | | 0.7 | | |
| D669 | Buried | | | 0.03 | | |
| V670 | Buried | | | 0 | | |
| R671 | Partial | | | 0.2 | | |
| V672 | Partial | | | 0.13 | | |
| A673 | Partial | | | 0.16 | | |
| N674 | Exposed | | | 0.7 | | |
| L675 | Exposed | | | 0.43 | | |
| K676 | Exposed | | | 0.65 | | |
| P677 | Exposed | | | 0.89 | | |
| R678 | Exposed | | | 0.6 | | |
| I679 | Partial | | | 0.17 | | |
| S680 | Exposed | | | 0.09 | | |
| F681 | Buried | | | 0.01 | | |
| N682 | Exposed | | | 0.3 | | |
| F683 | Buried | | | 0 | | |
| F684 | Buried | | | 0.03 | | |
| V685 | Buried | | | 0 | | |
| T686 | Buried | | | 0.02 | | |
| A687 | Exposed | | | 0.17 | | |

TABLE 4-continued

| Amino Acid in | | Fractional SASA | | | Differences in Fractional ASA | |
|---|---|---|---|---|---|---|
| Human ACE2 | Disposition | 1R42 | 1R4L | 6M17 | 1R42 – IR4L | 1R42 – 6M17 |
| P688 | Partial | | | 0.26 | | |
| K689 | Exposed | | | 0.78 | | |
| N690 | Exposed | | | 0.6 | | |
| V691 | Buried | | | 0.09 | | |
| S692 | Buried | | | 0.06 | | |
| D693 | Exposed | | | 0.55 | | |
| I694 | Partial | | | 0.25 | | |
| I695 | Partial | | | 0.1 | | |
| P696 | Exposed | | | 0.51 | | |
| R697 | Exposed | | | 0.3 | | |
| T698 | Exposed | | | 0.7 | | |
| E699 | Exposed | | | 0.25 | | |
| V700 | Buried | | | 0.01 | | |
| E701 | Exposed | | | 0.21 | | |
| K702 | Exposed | | | 0.56 | | |
| A703 | Buried | | | 0 | | |
| I704 | Buried | | | 0 | | |
| R705 | Exposed | | | 0.41 | | |
| M706 | Exposed | | | 0.32 | | |
| S707 | Buried | | | 0.1 | | |
| R708 | Partial | | | 0.1 | | |
| S709 | Exposed | | | 0.9 | | |
| R710 | Buried | | | 0.68 | | |
| I711 | Buried | | | 0.01 | | |
| N712 | Partial | | | 0.09 | | |
| D713 | Exposed | | | 0.73 | | |
| A714 | Buried | | | 0.42 | | |
| F715 | Buried | | | 0.02 | | |
| R716 | Exposed | | | 0.81 | | |
| L717 | Buried | | | 0 | | |
| N718 | Exposed | | | 0.58 | | |
| D719 | Exposed | | | 0.3 | | |
| N720 | Exposed | | | 0.76 | | |
| S721 | Partial | | | 0.03 | | |
| L722 | Buried | | | 0 | | |
| E723 | Exposed | | | 0.4 | | |
| F724 | Buried | | | 0 | | |
| L725 | Exposed | | | 0.35 | | |
| G726 | Exposed | | | 0.58 | | |
| I727 | Buried | | | 0.01 | | |
| Q728 | Exposed | | | 0.75 | | |
| P729 | Exposed | | | 0.6 | | |
| T730 | Exposed | | | 0.58 | | |
| L731 | Exposed | | | 0.9 | | |
| G732 | Exposed | | | 0.73 | | |
| P733 | Exposed | | | 0.85 | | |
| P734 | Exposed | | | 0.89 | | |
| N735 | Exposed | | | 0.73 | | |
| Q736 | Exposed | | | 0.85 | | |
| P737 | Exposed | | | 0.36 | | |
| P738 | Exposed | | | 0.77 | | |
| V739 | Exposed | | | 0.56 | | |
| S740 | Exposed | | | 0.47 | | |

In certain embodiments, the ACE2 mutein comprises one or more amino acid substitutions at a position with a buried amino acid side chain in human ACE2 (SEQ ID NO: 1). In certain embodiments, the one or more amino acid substitutions is selected from the substitutions identified in TABLE 5.

TABLE 5

| Amino Acid in human ACE2 | Substitution |
|---|---|
| F28 | Y, W |
| L29 | M, F, Y, W |
| F32 | Y, W |
| L100 | M, F, Y, W |
| G104 | A, P, V, I, L,M, H, F, Y,W |
| L116 | M, F, Y, W |

TABLE 5-continued

| Amino Acid in human ACE2 | Substitution |
|---|---|
| M123 | I, L, I, L F, Y, W |
| G130 | A, P, V, I, L, M, F, Y, W |
| L144 | M, F by space-fitting model, Y, W |
| G147 | A, P, V, I, L, M, H, F, Y, W |
| L148 | M, H, F, Y. W |
| M152 | I, L, H, F, Y, W |
| L162 | M, H, F, Y, W |
| G173 | A, P, V, I, L, M, H, F, Y, W |
| V184 | I, L, M, H, F, Y, W |
| A191 | V by algorithm, P, I, L, M, H, F, Y, W |
| G200 | A, P, V, I, L, M, H, F, Y, W |
| V226 | L by algorithm, I, M, H, F, Y, W |
| L236 | M, H, F, Y, W |
| L240 | M, H, F, Y, W |

TABLE 5-continued

| Amino Acid in human ACE2 | Substitution |
|---|---|
| A242 | A, P, V, I, L, M, H, F, Y, W |
| V244 | L by algorithm, I, L, M, H, F, Y, W |
| G260 | A, P, V, I, L, M, H, F, Y, W |
| L262 | M, H, F, Y, W |
| P263 | V, I, L, M, H, F, Y, W |
| A264 | P, V, I, L, M, H, F, Y,W |
| L266 | M, H, F, Y, W |
| L267 | M, H, F, Y, W |
| G268 | A, P, V, I, L, M, H, F, Y, W |
| M270 | I, L, I, L, L, Y, W |
| G272 | A, P, V, I, L, M, H, F, Y, W |
| L281 | M, H, F, Y, W |
| P284 | P, V, I, L, M, H, F, Y, W |
| I291 | M, H, F, Y, W |
| V293 | L by algorithm, I, L, M, H, F, Y, W |
| M297 | I, L, H, F, Y, W |
| I307 | M, I, L F, Y, W |
| A311 | V by algorithm, P, I, L, M, H, F, Y, W |
| F314 | Y, W |
| L320 | M, H, F, Y, W |
| M323 | I, L, H, F, Y, W |
| F327 | Y, W |
| L333 | F by space-filling model, M, H, Y, W |
| P346 | V, I, L, M, H, F, Y, W |
| A348 | P, V, I L, M, H, F, Y, W |
| L351 | F by space-filling model, M, H, Y, W |
| I358 | M, H, F, Y, W |
| M360 | I, L, H, F, Y, W |
| M366 | I, L, H, F, Y, W |
| F369 | Y, W |
| L370 | M, H, E Y, W |
| A372 | V by algorithm, P, I, L, M, H, F, Y, W |
| M376 | I, L, H F, Y, W |
| G377 | A by space-filling model and algorithm, P, V, I, L, M, H, F, Y, W |
| i379 | M, H, F, Y, W |
| M383 | I, L, H, F, Y, W |
| A384 | P, V, I, L, M, H, F, Y, W |
| L391 | M, H, F, Y, W |
| A396 | P, V, I, L, M, H, F, Y, W |
| G399 | A.P,V 1, 1.. MJ LEY. A |
| F400 | Y, W |
| A403 | P, V, I, L, M, H, F, Y, W |
| G405 | A, P, V, I, L, M, H, F, Y, W |
| L410 | M, H, F, Y, W |
| A413 | V by algorithm, P, I, L, M, H, F, Y. W |
| P415 | V, I, L, M, H, F, Y, W |
| L418 | M, H, F, Y, W |
| G422 | A by space-filling model, P, V, I, L, M, H, F, Y, W |
| L423 | F by space-filling model, M, H, Y, W |
| L424 | M, H, F, Y, W |
| F428 | Y, W |

TABLE 5-continued

| Amino Acid in human ACE2 | Substitution |
|---|---|
| I436 | M, H, F, Y, W |
| F438 | Y, W |
| L439 | M, H, F, Y, W |
| A443 | V by algorithm, P, I, L, M, FI, F, Y, W |
| L444 | M, H, E Y, W |
| I446 | M, H, F, Y, W |
| V447 | L and I by algorithm, M, H, F, Y, W |
| G448 | A and V by algorithm, P, I, L, M, H, F, Y, W |
| P451 | V, I, L, M, H, F, Y, W |
| M455 | I, L, H, F, Y, W |
| L456 | M, H, F, Y, W |
| V463 | L and F by algorithm, I, M, H, Y. W |
| F464 | Y, W |
| I468 | M, H, F, Y, W |
| V485 | I, L, M, H, F, Y, W |
| G486 | A by space-filling model, V, P, I, L, M, H, F, Y, W |
| V487 | I by algorithm, M, H, F, Y, W |
| P490 | V, I, L, M H, F, Y, W |
| P499 | V, I, L, M, H, F, Y, W |
| A501 | V by algorithm, P, I, L, M, H, F, Y, W |
| L503 | M, H, F, Y, W |
| V506 | I by algorithm, L, M H, F, Y, W |
| F512 | Y, W |
| I513 | M, H, F, Y, W |
| F523 | Y, W |
| F525 | Y, W |
| A528 | V, P, I, L, M, H, F, Y, W |
| L529 | M, H, F, Y, W |
| A533 | V by algorithm, P, I, L, M, H, F, Y, W |
| L539 | M, H, F, Y, W |
| I544 | M, H, F, Y. W |
| A550 | V, P, I, L, M, H, F, Y, W |
| G551 | A, V P, I L, M. H, E Y,W |
| L554 | M, H, F, Y, W |
| M557 | I, L H, F, Y, W |
| G561 | A by space-filling model, V, P, I, L, M, H, F, Y, W |
| P565 | V, I, L, M, H, F, Y, W |
| A569 | L by algorithm, V, P, I, M, H, F, Y, W |
| L570 | M, H, F, Y, W |
| V574 | I, L, M, H, F, Y, W |
| M579 | I, L, H, F, Y, W |
| V581 | I, L, M, H, F, Y, W |
| L584 | M, H, F, Y, W |
| L595 | M, H, E Y. W |
| P612 | V, I, L, M, H, F, Y, W |

In certain embodiments, the ACE2 mutein comprises one or more amino acid substitutions at a position that is a buried hydrophilic or aromatic amino acid in human ACE2 (SEQ ID NO. 1). In certain embodiments, the one or more substitutions is identified in TABLE 6.

TABLE 6

| Amino Acid in human ACE2 | Substitution |
|---|---|
| E22 | L, I, F, Y by space-filling model, P, M, H, W |
| N33 | L by space-filling model, P, V, I, L, M, H, F, Y, W |
| S44 | A in galago, lemur, sifaka, brown bats, and rabbits, V, I, M by space-filling model, P, L, H F, Y, W |
| S47 | A in tarsier, T by space-filling model, P, V, I, L, M, H, F, Y, W |
| N51 | V by space-filling model, P, I, L, M, H, F, Y, W |
| Q76 | I by space-filling model, L, M, H, F, Y, W |
| Q96 | L by space-filling model, I, M, H, F, Y, W |
| Q98 | L by space-filling model, I, M, H, F, Y, W |
| Q101 | L and M by space-filling model, I, H, F, Y, W |
| S167 | T by space-filling model, P, V, I, L, M, H, F, Y, W |
| N194 | I, L by space-filling model, P, V, M, H, F, Y, W |
| T229 | V by space-filling model, P, I, L, M, H, F, Y, W |
| H241 | F by space-filling model, I, L, Y, W |
| C261 | V, I, and M by space-filling model, P, L, H, F, Y, W |
| R273 | F by space-filling model, Y, W |
| T282 | M in ferret, V, I, L by space-filling model, P, M, H, F, Y, W |

TABLE 6-continued

| Amino Acid in human ACE2 | Substitution |
|---|---|
| S3 31 | T, V, I, and M by space-filling model, P, L, H, F, Y, W |
| T362 | V, I, L by space-filling model, P, M, H, F, Y, W |
| H373 | F, Y by space-filling model, I L, W |
| Q380 | I, M by space-filling model, L, H, F, Y, W |
| D382 | L by space-filling model, V, P, I M, H, F, Y, W |
| N397 | L by space-filling model, V, P, I, M, H, F, Y, W |
| S411 | T and V by space-filling model, P, I, L, M, H, F, Y, W |
| T414 | V by space-filling model, P, I, L, M, H, F, Y, W |
| T449 | V by space-filling model, P, I, L, M, H, F, Y, W |
| T454 | V by space-filling model, P, I, L, M, H, F, Y, W |
| E457 | I by space-filling model, P, L, M, H, F, Y, W |
| R460 | L, M by space-filling model |
| H493 | F by space-filling model, I, L, Y, W |
| C498 | V, I, and M by space-filling model, P, L, H, F, Y, W |
| T517 | V, I, E by space-filling model, P, M, H, F, Y, W |
| T519 | V, I, L, M by space-filling model, P, H, F, Y, W |
| Q526 | H in snub-nosed monkey, ungulates, whale, wombat, L, M, F by space-filling model, I, Y, W |

In certain embodiments, the ACE2 mutein comprises one or more amino acid substitutions at a position corresponding to A342, A412, A413, V447, A501, V506, A533, and V573 of human ACE2 (SEQ ID NO: 1). In certain embodiments, the ACE2 mutein comprises one or more substitutions selected from A342V, A412V, A413V, A413L, V447I, A501V, V506I, A533V, and V573I. In certain embodiments, the ACE2 mutein comprises one or more amino acid substitutions at a position corresponding to A342, V447, A501, and V506 of human ACE2 (SEQ ID NO: 1). In certain embodiments, the ACE2 mutein comprises one or more substitutions selected from A342V, V447I, A501V, and V506I.

C. Substitutions of Surface-Exposed or Partially-Ex Posed Hydrophobic Residues

As described further in the examples herein, an ACE2 mutein can be stabilized by substituting an exposed or a partially-exposed hydrophobic amino acid (e.g., alanine, valine, proline, isoleucine, leucine, methionine, or phenylalanine) by an amino acid having fewer carbon atoms or a lower molecular weight than the amino acid that is replaced (e.g., a hydrophilic amino acid).

In certain embodiments, the ACE2 mutein comprises one or more amino acid substitutions at a position corresponding to A387, V339, A301, and P289 of human ACE2 (SEQ ID NO: 1). In certain embodiments, the ACE2 mutein comprises a A387G, V339G, A301G, or V339D substitution. In certain embodiments, the ACE2 mutein comprises a V339G or V339D substitution. In certain embodiments, the ACE2 mutein further comprises a collectrin domain (e.g., an amino acid sequence at least 80% identical to amino acids 616-725 of wild-type human ACE2 (SEQ ID NO: 1). In certain embodiments, the ACE2 mutein further comprises K74C and S106C substitutions. In certain embodiments, the ACE2 mutein further comprises one or more space-filling substitutions that stabilize the hydrophobic interior.

In certain embodiments, the ACE2 mutein comprises one or more substitutions that redistribute hydrophobicity away from the surface and/or towards the interior of the protease domain (amino acids 19-615) of wild-type human ACE2 (SEQ ID NO: 1) at a position corresponding to I259, C261, V339, A342, and C498. In certain embodiments, the ACE2 mutein comprises one or more of the substitutions I259T, C261P, V339G, A342V, and C498M.

D. Substitutions Near SARS-CoV-2 Receptor-Binding Domain (RBD) Contacts in Human ACE2

In certain embodiments, the ACE2 mutein comprises one or more amino acid substitutions at a position near SARS coronavirus RBD contacts in human ACE2 (SEQ ID NO: 1). In certain embodiments, the one or more substitutions is in the region from S19-S106 and P336-M360 of human ACE2 (SEQ ID NO: 1). In certain embodiments, the one or more substitutions are identified in TABLE 7.

TABLE 7

| Amino Acid in human ACE2 | Substitution |
|---|---|
| I21 | P in tarsier, F or W by space-fitting model, M, H, Y |
| E22 | L, I, F, Y by space-filling model, P, M, H, W |
| A25 | V in tarsier, L by space-fitting model, P, I, M, H, F, Y, W |
| F28 | Y, W |
| L29 | M, F, Y, W |
| F32 | Y, W |
| N33 | L by space-filling model, P, V, I, L, M, H, F, Y, W |
| A36 | V in galago, P, I, L, M, H, F, Y, W |
| F40 | Y in tarsier and panda, W |
| S44 | A in galago, lemur, sifaka, brown bats, and rabbits, V, I, M by space-filling model, P, L, H, E Y, W |
| S47 | A in tarsier, T by space-filling model, P, V, I L, M, H, F, Y, W |
| N51 | V by space-filling model, P, I, L, M, H, F, Y, W |
| G66 | A in mouse, rat, and wombat, P, V, I, L, M, F, Y, W |
| L73 | F in new world primates, Y in prosimians, M, H, W |
| Q76 | I by space-filling model, L, M H, F, Y, W |
| ASO | V by algorithm, I by space-filling model, P, L, M, H, F, Y, W |
| I88 | V in rabbits, F by space-filling model, M, H, Y, W |
| L91 | P in mice, A in civets, M, H, F, Y, W |
| L95 | M, H, F, Y, W |
| Q96 | L by space-filling model, I, M, H, F, Y, W |
| Q98 | L by space-filling model, I, M, El, F, Y, W |
| A99 | V in gray mouse lemur and brown bats, I in flying foxes, P, L, M, H, F, Y, W |
| Q101 | L and M by space-filling model, I, H, F, Y, W |
| A342 | V in all primates except great apes, V in all mammals, I by space-filling model, P, I, L, M, H, F, Y, W |
| V343 | I in lemur and sifaka, L, M, H, F, Y, W |
| P346 | V, I, L, M, H, F, Y, W |
| A348 | P,V, I, L, M, H, F, Y, W |
| L351 | F by space-filling model, M, H, Y, W |
| I358 | M, H, F, Y, W |
| L359 | I in all old world monkeys except colobus, M. H, F, Y, W |
| M360 | I, L, H, F, Y, W |

E. Substitutions in the Collectrin Domain

ACE2 muteins can optionally can include a collectrin domain (FIG. 1B). The collectrin domain corresponds approximately to amino acids 616-740 of human ACE2 (SEQ ID NO: 1). The collectrin domain contains a homodimerization interface.

In certain embodiments, the ACE2 mutein comprises an amino acid sequence at least 80% identical to amino acids 19-615 of wild-type human ACE2 (SEQ ID NO: 1) and a collectrin domain with an amino acid sequence at least 80% identical to amino acids 616-725 of wild-type human ACE2 (SEQ ID NO: 1). In certain embodiments, the collectrin domain includes at least one substitution of a buried amino acid in wild-type human ACE2 (SEQ ID NO: 1) by a hydrophobic or aromatic amino acid having a molecular weight equal to or greater than the molecular weight of the amino acid that is replaced. In certain embodiments, the collectrin domain includes at least one substitution of a solvent-exposed hydrophobic amino acid (e.g., an alanine, valine, proline, isoleucine, leucine, methionine, or phenylalanine) by an amino acid having fewer carbon atoms or a lower molecular weight than the amino acid that is replaced (e.g., a hydrophilic amino acid). In certain embodiments, the collectrin domain comprises at least one substitution of a partially buried serine in wild-type human ACE2 (SEQ ID NO: 1) by a threonine. In certain embodiments, the collectrin domain comprises at least one cysteine.

In certain embodiments, the ACE2 mutein comprises at least one of the amino acid substitutions S645C, S692C, and A714C of wild-type human ACE2 (SEQ ID NO: 1).

In certain embodiments, the ACE2 mutein comprises at least one substitution at A632, L642, S645, S646, V647, L656, R671, V672, A673, L675, V691, M706, A714, or S721 of wild-type human ACE2 (SEQ ID NO. 1).

In certain embodiments, the ACE2 mutein comprises at least one of the amino acid substitutions A632P, L642F, S645T, S645V, S645I, S646T, S646L, S646M, S646L, S646F, V647I, L656F, R671L, V672I, A673L, A673F, L675I, L675F, V691L, V691I, V691M, M706F, A714V, A714I, and S721T of wild-type human ACE2 (SEQ ID NO: 1).

In certain embodiments, the collectrin domain includes at least one substitution of a buried amino acid in wild-type human ACE2 (SEQ ID NO: 1) by a hydrophobic or aromatic amino acid having a molecular weight equal to or greater than the molecular weight of the amino acid that is replaced. In certain embodiments, the ACE2 mutein comprises at least one substitution at V620, I622, S645, S646, V647, A650, V657, V670, V672, L675, I679, V685, I695, V700, I704, S707, I711, A714, S721, and F724. In certain embodiments, the ACE2 mutein comprises at least one of the amino acid substitutions V620L, V620L, I622L, S645T, S645V, S645I, S646T, S646V, S646L, V647L, V647L, A650V, A650I, V657I, V670I, V670L, V672I, V672L, L675F, I679L, V685I, V685L, I695T, V700I, V700L, I704L, S707L, I711L, A714V, A714I, S721T, and F724W. In certain embodiments, the ACE2 mutein comprises substitutions at V620 and/or V647. In certain embodiments, the ACE2 mutein comprises V620I and/or V647I substitutions. In certain embodiments, the ACE2 mutein comprises substitutions at at least one of amino acids V620, I622, A650, and V685. In certain embodiments, the ACE2 mutein comprises at least one of the following substitutions: V620L, I622L, A650V, A650I, and V685L. In certain embodiments, the ACE2 mutein further comprises one or more substitutions at amino acids K74, S106, A342, and A714. In certain embodiments, the ACE2 mutein further comprises at least one of a K74C, S106C, A342V, and an A714C substitution. In certain embodiments, the ACE2 mutein further comprises substitutions at amino acids K74, S106, A342, and A714. In certain embodiments, the ACE2 mutein further comprises K74C, S106C, A342V, and A714C substitutions. In certain embodiments, the ACE2 mutein further comprises Fc domain, such as an IgG2 Fc domain.

In certain embodiments, the ACE2 mutein comprises one or more substitutions that redistribute hydrophobicity away from the surface and/or towards the interior of the collectrin domain (amino acids 616-723) of wild-type human ACE2 (SEQ ID NO: 1). For example, in certain embodiments, the collectrin domain includes at least one substitution of a solvent-exposed hydrophobic amino acid (e.g., an alanine, valine, proline, isoleucine, leucine, methionine, or phenylalanine) by an amino acid having fewer carbon atoms or a lower molecular weight than the amino acid that is replaced (e.g., a hydrophilic amino acid). For example, an ACE2 mutein can include a substitution at one or more positions corresponding to V620, I622, A650, L656, M662, L664, P677, V685, and/or I695 of wild-type human ACE 2 (SEQ ID NO: 1). In certain embodiments, the ACE2 mutein comprises a substitution of M662 with an amino acid other than an S or a T (e.g., G, D, or A). In certain embodiments, an ACE2 mutein comprises one or more of the substitutions V620I, I622L, A650V, A650I, L656S, M662A, M662G, M662D, L664G, L664P, P677G, V685L, and/or I695T. In certain embodiments, an ACE2 mutein comprises one or more of the substitutions V620I, I622L, A650V, A650I, L656S, M662A, M662G, M662D, L664G, L664P, V685L, and/or I695T.

In certain embodiments, the ACE2 mutein comprises one or more of the amino acid substitutions within the collectrin domain at a position that differs between human ACE2 (SEQ ID NO: 1) and non-human primate (NHP) ACE2 in the region from Q616 to S740 identified in TABLE 8.

TABLE 8

| Amino Acid in human ACE2 | Substitution |
| --- | --- |
| A632 | P in galago, V, I, L, M, H, F, Y, W |
| L642 | F in tarsier and vampire bat, M, H, F, Y, W |
| V647 | I in Ma's night monkey, L, M, H, F, Y, W |
| L656 | F in Ma's night monkey, M, H, Y, W |
| V672 | I in tarsier, L, M, H, F, Y, W |
| L675 | F in golden snub-nose monkey and gray mouse lemur, I in galago, M, H, Y, W |
| V691 | L in tarsier, I, M, H, F, Y, W |
| M706 | F in African green monkey, I, L, H, Y, W |
| A714 | V in gray mouse lemur and Coquerel's sifaka, P, I, L, M, H, F, Y, W |

In certain embodiments, the ACE2 mutein comprises one or more of the amino acid substitutions within the collectrin domain of human ACE2 (SEQ ID NO: 1) in the region from Q616 to S740 identified in TABLE 9.

TABLE 9

| Amino Acid in human ACE2 | Substitution |
|---|---|
| S645 | C for disulfide, V in wombat, V or I by space-filling model, T, P, L, M, H, F, Y, W |
| S646 | I in certain bats, fox, pig, dog, ferret, panda, sea lion, seal, palm civet, and wombat, V, P, L, M, H, F, Y,W |
| L656 | F in wombat, M, H, F, Y, W |
| A673 | F in wombat, L and I by space-filling model, V, P, M, H, Y, W |
| V691 | M in brown bats, pigs, whales, ferret, and sea lion, I, L, H, F, Y, W |
| A714 | C for disulfide, V in mouse, 1 in rat, P, L, M, H, F, Y, W |
| S72I | T in little brown bat, V, P, I, L, M, H, F, Y, W |

F. Hydrophobic Substitutions in a Hydrohalic Residue

In certain embodiments, the ACE2 mutein comprises at least one substitution of a hydrophilic residue at a position corresponding to E22, N33, S44, S47, N51, Q76, Q96, Q98, Q101, S167, N194, T229, H241, C261, R273, T282, S331, T362, H373, Q380, D382, N397, S411, T414, T449, T454, E457, R460, H493, C498, T517, T519, or Q526 of wild-type human ACE2 (SEQ ID NO: 1). In certain embodiments, the ACE2 mutein comprises at least one substitution selected from E22L, E22I, E22F, E22Y, N33L, S44V, S44I, S44M, S47T, N51V, Q76I, Q96L, Q98L, Q101L, Q101M, S167T, N194I, N194L, T229V, H241F, C261I, C261M, C261P, C261V, C261S, R273F, R273Q, T282M, T282V, T282I, T282L, S331T, S331V, S331I, T362L, T362V, T362I, H373F, H373Y, Q380I, Q380M, D382L, N397L, S411T, S411V, T414V, T449V, T454V, E457I, R460L, R460M, H493F, C498V, C498M, T517V, T517I, T517L, T517M, T519V, T519I, T519L, T519M, Q526H, Q526L, Q526M, and Q526F of wild-type human ACE2 (SEQ ID NO: 1).

G. Substitutions for Closing the Substrate-Binding Cleft of ACE2

ACE2 is an enzyme with a large cleft that binds its substrate, angiotensin II (AngII). The disclosure further relates to a protein comprising a human angiotensin-converting enzyme 2 (ACE2) mutein, wherein the human ACE2 mutein comprises an amino acid sequence at least 80% identical (e.g., at least 85%, 90%, 95%, 98%, 99%) to amino acids 19-615 of wild-type human ACE2 (SEQ ID NO: 1), and comprises at least two cysteine amino acid substitutions, wherein one of the cysteine amino acids is disposed on one side of the angiotensin II substrate-binding cleft of ACE2 and the other one of the cysteine amino acids is disposed on the opposite side of the cleft, wherein the cysteines optionally form a disulfide bond. Without wishing to be bound by theory, it is believed that the pair of cysteine residues forms a disulfide across the substrate-binding cleft of ACE2, and that disulfide constrains ACE2 in a closed or partially-closed conformation. Such mutations can improve the stability and pharmacokinetics (PK) of the protein, while also providing an alternate means of rendering the protein catalytically inactive.

Accordingly, in certain embodiments, cysteine substitutions form a disulfide bond, increase the thermal stability of the protein, or increase the plasma half-life of the protein in an animal, relative to human wild-type ACE2. In certain embodiments, the cysteine substitutions comprise K74C and S106C or S128C and V343C. In certain embodiments, the protein does not comprise C344 or C361.

In certain embodiments, formation of a disulfide bond between the cysteine substitutions is enhanced by the use of a small molecule inhibitor of ACE2 such as MLN-4760. MLN-4760 is (S,S)-2-{1-carboxy-2-[3-(3,5-dichloroben-zyl)-3H-imidazol4-yl]-ethylamino}-4-methylpentanoic acid. Exemplary small molecules inhibitors of ACE2 include MLN-4760, N-(2-aminoethyl)-1 aziridine-ethanamine; 3-Phenylhydrazonopentane-2,4-dione; 5-Methyl-8-quinoli-nol, Tiliquinol; and 1-Chloro-2-ethylbenzene (Towler et al. (2004) J BIOL CHEM. 279(17):17996-8007, Huentelman et al. (2004) HYPERTENSION 44(6):903-6). Other inhibitors of ACE2 include derivatives of (S,S)-2-{1-carboxy-2-[3-(3,5-dichlo-robenzyl)-3H-imidazol4-yl]-ethylamino}-4-methylpen-tanoic acid. Molecules that inhibit ACE2 can be identified by methods known in the art (Huentelman et al., supra). Accordingly, in certain embodiments the disclosure relates to a composition including a protein comprising an ACE2 mutein and a small molecule inhibitor of ACE2. In certain embodiments the disclosure relates to a composition includ-ing a protein comprising an ACE2 mutein that comprises a pair of cysteine substitutions and a small molecule inhibitor of ACE2. In certain embodiments, the composition is a pharmaceutical composition.

In certain embodiments, the ACE2 mutein comprises a substitution at position E37, R393, H345, and/or F504 corresponding to wild-type human ACE2 (SEQ ID NO: 1), which may reduce substrate accessibility to (e.g., promote a closed conformation of) the substrate-binding cleft. In cer-tain embodiments, the protein comprises an ACE2 mutein comprising at least one substitution at position H345 or F504 corresponding to wild-type human ACE2 (SEQ ID NO: 1). Specifically, mutations that may promote a closed conformation include H345I, H345L, H345F, H345Y, H345W, and/or F504W. Without wishing to be bound by theory, it is believed that a substitution at position H345 or F504 promotes the closed confirmation of ACE2 even in the absence of a small-molecule inhibitor such as MLN-4760. In certain embodiments, the protein comprises at least one substitution at position H345 or F504 of wild-type human ACE2 (SEQ ID NO: 1) and a pair of cysteine substitutions, wherein one of the cysteine amino acids is disposed on one side of the angiotensin H substrate-binding cleft of ACE2 and the other one of the cysteine amino acids is disposed on the opposite side of the cleft.

In certain embodiments, an ACE2 mutein comprises the cysteine substitutions K74C and S106C and the substitution H345Y.

H. Catalytically Inactive ACE2 Muteins

A protein comprising (i) a substantially catalytically inac-tive human angiotensin-converting enzyme 2 (ACE2) mutein, wherein the human ACE2 mutein comprises an amino acid sequence at least 80% identical to amino acids 19-615 of wild-type human ACE2 (SEQ ID NO: 1) and optionally (ii) an antibody Fc domain, wherein said ACE2 mutein does not comprise the amino acid substitution H374N and/or H378N.

In certain embodiments, substantially catalytically inac-tive human ACE2 mutein has less than 30, 25, 20, 15, 10, 5, 4, 3, 2, or 1% of wild type ACE2 catalytic activity. In certain embodiments, catalytic activity of an ACE2 mutein is measured by methods known in the art, e.g., as described by Liu et al. (2017) ScI REP. 7:45473. Catalytic activity of an ACE2 mutein can be measured using a commercially-available kit from Biovision (Catalog #K897, Angiotensin II Converting Enzyme (ACE2) Activity Assay Kit (Fluorometric)). In certain embodiments, catalytic activity of ACE2 can be measured by assessing the conversion of angiotensin II (AngII) to angiotensin 1-7 (Ang1-7) by HPLC.

In another aspect, the disclosure relates to a protein comprising a substantially catalytically inactive human angiotensin-converting enzyme 2 (ACE2) mutein, wherein the human ACE2 mutein comprises an amino acid sequence at least 80% identical to amino acids 19-615 of wild-type human ACE2 (SEQ ID NO: 1) and optionally an antibody Fc domain. In certain embodiments, the ACE2 mutein does not comprise the amino acid substitution H374N. In certain embodiments, the ACE2 mutein does not comprise the amino acid substitution H378N.

In certain embodiments, the catalytically inactive ACE 2 mutein does not comprise a histidine or an asparagine at position 374 of ACE2 (SEQ ID NO: 1) or does not comprise a histidine or asparagine at position 378 of ACE2 (SEQ ID NO: 1).

In certain embodiments, the catalytically inactive ACE 2 mutein comprises a non-native pair of cysteine residues (i.e., two cysteine substitutions), wherein at least one of the non-native cysteine residues is at a position corresponding to H374 or H378 of human ACE2 (SEQ ID NO: 1). For example, the catalytically inactive ACE 2 mutein can include the substitution H374C and G405C, H374C and S409C, or H374C and G405C.

In certain embodiments, the catalytically inactive ACE 2 mutein comprises a substitution at the position corresponding to R273, H345, P346, T371, E475, E402, H505, or Y515 of human ACE2 (SEQ ID NO: 1). In certain embodiments, substitution is selected from R273F, R273Q, H345A, H345I, H345L, H345F, H345Y, or H345W of human ACE2 (SEQ ID NO: 1).

I. Substitutions for Preventing Unwanted Nonphysiologic Homodimerization

In certain embodiments, the ACE2 mutein comprises a substitution that prevents unwanted (e.g., nonphysiologic) homodimerization. Accordingly, in certain embodiments, the human ACE2 mutein comprises an amino acid sequence at least 80% identical to amino acids 19-615 of wild-type human ACE2 (SEQ ID NO: 1), and comprises at least one substitution or deletion at a position corresponding to M249, P258, I259, or F603 of wild-type human ACE2 (SEQ ID NO: 1), e.g., M249T, M249S, P258G, P258S, I259S, I259T, F603G, and F603Y.

J. Other Substitutions that Increase Coronavirus Neutralization

In certain embodiments, the ACE2 mutein exhibits increased coronavirus neutralization. For example, the at least one insertion, deletion, or substitution can decrease the concentration of the protein needed to neutralize 80% of the infectivity of a virus or pseudovirus comprising the spike (S) protein of SARS-CoV-1 or SARS-CoV-2 relative to human ACE2. In certain embodiments, the concentration of the mutein needed to neutralize 80% of the infectivity of a virus or pseudovirus comprising the spike (S) protein of SARS-CoV-1 or SARS-CoV-2 relative to human ACE2 is reduced by more than 90%, more than 80%, more than 70%, more than 60%, more than 50%, more than 40%, more than 30%, more than 20%, or more than 10%.

In certain embodiments, the neutralizing activity of the ACE2 mutein is increased by 5%, 10%, 20%, 30%, 40%, 50%, 60%, 70%, 80%, 90%, 100%, 150%, 200%, 250%, 500% or more relative to wild type ACE2.

Neutralization activity can be measured by any means known in the art, including, for example, using SARS coronavirus S protein pseuodoviruses on MLV vectors encoding Firefly luciferase, incubating the pseudoviruses with the mutein, adding ACE2 expressing cells, and measuring luciferase activity.

In certain embodiments, the ACE2 mutein exhibiting increased coronavirus neutralization comprises a substitution at one or more of A25, Q24, T27, D30, H34, N90, and A342, wherein the amino acid numbering corresponds to that of human ACE2 (SEQ ID NO: 1). In certain embodiments, the ACE2 mutein comprises a A25V, Q24E, T27K, D30E, H34S, N90D, or A342V substitution, or combinations thereof. In certain embodiments, the ACE2 mutein comprises A25V and T27K, A25V and D30E, A25V and H34S, A25V and N90D, or A25V and A342V substitutions. In certain embodiments, the ACE2 mutein comprises A25V and N90D substitutions. In certain embodiments, the ACE2 mutein does not comprise a substitution at Q24. In certain embodiments, the ACE2 mutein does not comprise a Q24E substitution. In certain embodiments, the ACE2 mutein comprises substitutions at A25V and not at Q24E.

In certain embodiments, the ACE2 mutein comprises substitutions at A25, N90, and A342. In certain embodiments, the ACE2 mutein comprises A25V, N90D, and A342V substitutions. In certain embodiments, the ACE2 mutein comprises substitutions at A25, N90, and A342, and one or more of K27, L29, H34, N49, N90, L351, and A386. In certain embodiments, the ACE2 mutein comprises A25V, N90D, and A342V substitutions, and one or more of K27T, L29F, H34S, N49E, N90D, L351F, and A386L substitutions. In certain embodiments, the ACE2 mutein comprises substitutions at A25, N90, and A342 and a substitution at one of the following positions or combinations of positions: (a) L29, (b) A386, (c) L29 and A386, or (d) T27, H34, and N49. In certain embodiments, the ACE2 mutein comprises A25V, N90D, and A342V substitutions and one of the following substitutions or combinations of substitutions: (a) L29F, (b) A386L, (c) L29F and A386L, or (d) T27K, H34S, and N49E. In certain embodiments, the ACE2 mutein comprises substitutions at A25, N90, and A342; A25, T27, H34, N49, N90, and A342; A25, L29, N90, and A342; A25, N90, A342, and A386; A25, L29, N90, A342, and A386; A25, L29, N90, A342, L351, and A386; A25, T27, L29, H34, N49, N90, A342, L351, and A386. In certain embodiments, the ACE2 mutein comprises one or more of the following combinations of substitutions: A25V, N90D, and A342V; A25V, T27K, H34S, N49E, N90D, and A342V; A25V, L29F, N90D, and A342V; A25V, N90D, A342V, and A386L; A25V, L29F, N90D, A342V, and A386L; A25V, L29F, N90D, A342V, L351F, and A386L; A25V, T27K, L29F, H34S, N49E, N90D, A342V, L351F, and A386L. In certain embodiments, the ACE2 mutein further comprises I259S or I259T and C261S or C261P substitutions. In certain embodiments, the ACE2 mutein further comprises a collectrin domain (e.g., an amino acid sequence having at least 80% sequence identity to amino acids 616 to 723 of human ACE2 (SEQ ID NO: 1)).

K. Combinations

In certain embodiments, the ACE2 muteins described herein can include more than one amino acid deletion, addition, or substitution. Certain combinations of amino acid substitutions may be desirable. For example, combina-

55 tions of substitutions of buried amino acids S19-S106 or P336-M360 may be desirable because, under certain circumstances, they can provide a stability, affinity, and/or neutralization potency benefit without (i) creating a surface change that could be recognized as a neoepitope by an anti-drug antibody (ADA) response or (2) creating a difference that may impact recognition of variants of SARS coronaviruses. Thus, internal substitutions in the region from S19-S106 and P336-M360, including two or more substitutions at positions selected from I21, A25, L29, A36, S43, A65, F72, L73, V93, L97, A99, L100, A342, V343, and L351 of human ACE2 (SEQ ID NO: 1) may be combined to improve virus neutralization without creating a neoepitope or a difference that could be exploited by a variant of a SARS coronavirus. Specifically, amino acid substitutions that may be combined in this region include I21, I21F, or I21W; A25V; L29F; A36V; S43T, A65V, A65L, or A65L; F72Y; L73F or L73Y; V93P, V93I, or V93L; L97F; A99V, A99L, A99F, or A99Y; L100M, L100F, or L100W; A342V; V343I; and L351F. In certain embodiments, combinations may include A25V, L29F, S43T, L73F, V93P, A342V, and L351F.

Certain combinations of amino acid substitutions may be desirable for stabilizing a conformation of an ACE2 mutein in which substrate accessibility to the angiotensin II substrate-binding cleft is reduced (e.g., closed). Such substitutions may be considered in two groups: (1) substitutions that promote a closed conformation, and (2) cysteine amino acid substitutions that allow a disulfide bond to form across opposite sides of the angiotensin II substrate-binding cleft. For example, K74C and S106C substitutions introduce non-native cysteines on opposite sides of the angiotensin II substrate-binding cleft, and promote a substantial increase in thermal stability. Likewise, S128C and V343C introduce non-native cysteines on opposite sides of the angiotensin 11 substrate-binding cleft, resulting in an ACE2 protein that is expressed. An ACE2 mutein comprising S128C and V343C substitutions can also include additional substitutions, e.g., C344 and C361. K74C, S106C, S128C, and V343C. As discussed further in the Examples, when the closed conformation of a variant containing K74C, S106C, S128C, and V343C was stabilized, e.g., with the ACE2-Ig inhibitor MLN-4760, a particularly homogeneous protein preparation resulted. This result suggested that K74C and S106C substitutions and/or S128C and V343C substitutions can be combined with substitutions that promote a closed conformation.

Substitutions at positions E37, R393, H345, and/or F504 may promote a closed conformation. Specifically, mutations that may promote a closed conformation include H345I, H345L, H345F, H345Y, H345W, and/or F504W. Other mutations that promote a closed conformation of an ACE2 mutein include those where the fractional accessible surface area (ASA) is greater in the native ACE2 structure 1R42 than in the MLN-4760 inhibitor-bound ACE2 structure 1R4L, listed in TABLE 4 and FIG. 4. Such mutations may be combined with each other, combined with cysteine amino acid substitutions that allow a disulfide bond to form across opposite sides of the angiotensin II substrate-binding cleft, and/or combined with other substitutions. Indeed, certain ACE2 muteins that include substitutions or combinations of substitutions that stabilize a conformation of an ACE2 mutein where substrate accessibility to the angiotensin II substrate-binding cleft is reduced (e.g., closed) also include other substitutions that enhance SARS coronavirus neutralization potency and/or thermal stability.

56

Combinations of substitutions including substitutions in the collectrin domain (amino acids 616-723 or 616-740 of human ACE2 (SEQ ID NO: 1)) may be desirable. This is, in part, because variants that include the collectrin domain can improve SARS coronavirus neutralization.

In addition, in certain embodiments, substitutions within the collectrin domain can be combined with other substitutions, within and outside of the collectrin domain. Substitutions in the collectrin domain can include those that can form a disulfide across the homodimerization interface of the collectrin domain, e.g., S645C or A714C. Indeed, a A714C substitution is useful for forming a disulfide across the homodimerization interface of the collectrin domain, and can be combined with other amino acid substitutions within the collectrin domain or outside of the collectrin domain. Substitutions within the collectrin domain that may be paired with a non-native cysteine, e.g., A714C, include other amino acid substitutions at the interface of the collectrin domain, e.g., at positions E634, N638, E639, Y641, L642, S645, S646, Y649, R652, K657, S709, R710, D713, and R716.

Substitutions that affect the homodimerization interface of the collectrin domain also may be desirable. Without the intention of being limited by any particular theory, substitutions that promote homodimerization of the collectrin domain may promote the stability of the ACE2 mutein, whereas those that reduce the efficiency of homodimerization may improve the homogeneity of ACE2 muteins containing an Fc, e.g., by reducing the formation of oligomers having a greater molecular weight than an ACE2-Ig homodimer. Substitutions that affect collectrin domain homodimerization can be combined with substitutions that form a disulfide across the collectrin domain homodimer interface, e.g., A714C. Also, in certain embodiments, substitutions that affect collectrin domain homodimerization can be combined with substitutions that promote SARS coronavirus neutralization, thermal stability, and/or stabilize a conformation of an ACE2 mutein where substrate accessibility to the angiotensin II substrate-binding cleft is reduced (e.g., closed).

In certain embodiments, it may be desirable to eliminate a naturally-occurring cysteine. For instance, substitution of amino acid C261 can be desirable in embodiments containing an antibody hinge. In certain embodiments, muteins comprising a A714C substitution may be combined with a substitution or deletion of amino acid C261 and/or C498. In particular, combinations where a A714C substitution is present and C261 is substituted may be desirable. The non-native cysteines 128C and V343C can be introduced in combination with a deletion or substitution at amino acids C344 and C361. Thus, substituting naturally-occurring cysteines may be desirable in combination with the substitutions described above that promote SARS coronavirus neutralization, thermal stability, stabilize a conformation of an ACE2 mutein where substrate accessibility to the angiotensin II substrate-binding cleft is reduced (e.g., closed), form a disulfide across the homodimerization interface of the collectrin domain, and/or affect homodimerization of the collectrin domain.

In certain embodiments, an ACE2 mutein comprises a set of substitutions at the amino acid residues indicated in TABLE 10, or comprising or consisting of the substitutions listed in TABLE 10.

TABLE 10

| Amino acid residue (corresponding to wt ACE2 sequence in SEQ ID NO: 1) | Substitution(s) |
|---|---|
| C133, C141 | C133S, C141S |
| H374, H378 | H374N, H378N |
| A25, A342 | A25V, A342V |
| H374, G405 | H374C, G405C |
| H374, S409 | H374C, S409C |
| K74, S106 | K74C, S106C |
| S128, V343 | S128C, V343C |
| S128, V343, C344, C361 | S128C, V343C, C344S, C361S |
| T276, D367 | T276C, D367C |
| K74, S106, S128, V343, C344, C361 | K74C, S106C, S128C, V343C, C344S, C361S |
| K74, S106, T276, D367 | K74C, S106C, T276C, D367C |
| S128, V343, C344, C361, T276, D367 | S128C, V343C, C344S, C361S, T276C, D367C |
| K74, S106, S128, V343, C344, C361, T276, D367 | K74C, S106C, S128C, V343C, C344S, C361S, T276C, D367C |
| H345, F504 | H345Y, F504W |
| | H345L, F504W |
| | H345F, F504W |
| S645, A7I4 | S645C, A714C |
| H374, H378, S645 | H374N, H378N, S645C |
| H374, H378, A714 | H374N, H378N, A714C |
| H374, H378, S645, A714 | H374N, H378N, S645C, A714C |
| A25, Q24 | A25V, Q24E |
| A25 T27 | A25V, T27K |
| A25, D30 | A25V, D30E |
| A25, H34 | A25V, H34S |
| A25, N90 | A25V, N90D |
| A25, A342 | A25V, A342V |
| A25, N90,1259, C261, A342 | A25V, N90D, I259S, C261S, A342V |
| A25, L29, N90,1259, C2bL A342 | A25V, L29F, N90D, I259S, C261S, A342V |
| A25, N90,1259, C261, A342, A386 | A25V, N90D, I259S, C261S, A342V, A386L |
| A25, L29, N90,1259, C261, A342, A3 86 | A25V, L29F, N90D, I259S, C261S, A342V, A386L |
| A25, T27, H34, N49, N90,1259, C261, A342 | A25V, T27K, H34S, N49E, N90D, I259S, C261S, A342V |
| A25, N90, A342 | A25V, N90D, A3 42V |
| A25, T27, H34, N49, N90 | A25V, T27K, H34S, N49E, N90D |
| A25, L29, N90, A342 | A25V, L29F, N90D, A342V |
| A25, N90, A342, A386 | A25V, N90D, A342V, A386L |
| A25, L29, N90, A342, A386 | A25V, L29F, N90D, A342V, A386L |
| A25, L29, N90, 1259, C261, A342, A3 86 | A25V, L29F, N90D, 1259S, C261S, A342V, A386L |
| A25, L29, N90, A342, L351, A386 | A25V, L29F, N90D, A342V, L351F, A386L |
| A25, L29, N90, 1259, C261, A342, L351, A3 86 | A25V, L29F, N90D, 1259S, C261S, A342V, L351F, A386L |
| A25, T27, L29, H34, N49, N90, A342, L351, A3 86 | A25V, T27K, L29F, H34S, N49E, N90D, A342V, L351F, A386L |
| A25, T27, L29, H34, N49, N90,1259, C261, A342, L351, A386 | A25V, T27K, L29F, H34S, N49E, N90D, 1259S, C261S, A342V, L351F, A386L |
| V620, V647 | V620I, V647I |
| V647, V700 | V647I, V700L |
| V647, V670, A714 | V647I, V670L, A714C |
| V647, A714 | V647L, A714C |
| 1622, A714 | I622L, A714C |
| 1622,1679, V647 | I622L, I679L, V647I |
| 1622, 1679, V647, A7I4 | I622L, I679L, V647I, A714C |
| 1622,1679, V647, V670 | I622L, I679L, V647I, V670I |
| 1622, 1679, V647, V670, A714 | 1622L, 1679L, V647I, V6701, A714C |
| A714, V620, V647 | A714C, V620I, V647I |
| A714, V647, V700 | A714C, V647I, WOOL |
| K74, Si06, V339 | K74C, S106C, V339D |
| K74, S106, S128, V343 | K74C, S106C, S128C, V343C |
| K74, S106, A714 | K74C, S106C, A714C |
| K74, S106,1695, A714 | K74C, S106C, 16951, A714C |
| K74, S106,1622,1695, A7I4 | K74C, S106C, 1622L, I695T, A714C |
| S43, G66 | S43C, G66C |
| K74, G66, K74, S106, S128, V343 | K74C, G66C, K74C, S106C, S128C, V343C |
| K74, S128, V339, V343, f1345 | K74C, S128C, V339G, V343C, H345Y |
| S43, G66, K74, S128, V339, V343, H345 | S43C, G66C, K74C, S128C, V339G, V343C, H345Y |
| K74, S106, S128, V343, H345 | K74C, S106C, S128C, V343C, H345Y |
| A25, A342, A714 | A25V, A342V, A714C |
| A25V, K74, S106, A342 | A25V, K74C, S106C, A342V |
| A25, S128, V343, A342, C344, C361 | A25V, S128C, A342V, V343C, C344S, C361S |
| A25, K74, S106, S128, A342, V343, C344, C361 | A25V, K74C, S106C, S128C, A342V, V343C, C344S, C361S |
| A25, K74, S106, S128, A342, V343, C344, H345, C361 | A25V, K74C, S106C, S128C, A342V, V343C, C344S, H345W, C361S |

TABLE 10-continued

| Amino acid residue (corresponding to wt ACE2 sequence in SEQ ID NO: 1) | Substitution(s) |
|---|---|
| A25, K74, S106, S128, A342, V343, C344, H345, C361, F504 | A25V, K74C, S106C, S128C, A342V, V343C, C344S, H345W, C361 S, F504W |
| A25, K74, S106,I259, C261, A342, F603 | A25V, K74C, S106C, I259S, C261S, A342V, F603G |
| A25,I259, S128, C261, A342, V343, C344, C361, F603 | A25V, I259S, S128C, C261S, A342V, V343C, C344S, C36IS, F603G |
| A25, K74, S106, S128,I259, C261, A342, V343, C344, C361, F603 | A25V, K74C, S106C, S128C, I259S, C261S, A342V, V343C, C344S, C361S, F603G |
| A25, K74, SI 06, S128,I259, C261, A342, V343, C344, H345, C361, F603 | A25V, K74C, S106C, S128C, I259S, C261S, A342V, V343C, C344S, H345W, C361 S, F603G |
| A25, K74, S106, S128,I259, C261, A342, V343, C344, H345, C361, F504, F603 | A25V, K74C, S106C, S128C, I259S, C261S, A342V, V343C, C344S, H345W, C361S, F504W, F603G |
| A25, K74, S106, S128, I259, C261, A342, V343, C344, H345, C361, F504, F603, A714 | A25V, K74C, S106C, S128C, I259S, C261S, A342V, V343C, C344S, H345W, C361S, F504W, F603G, A714C |
| A25, L29, K74, S106,I259, C261, V339, A342, H345, A386, V620,I622, A650, L656, L664, V685, I695, A714 | A25V, L29F, K74C, S106C, I259T, C261P, V339G, A342V, H345Y, A386L, V620I, I622L, A650V, L656S, L664G, V685L, I695T, A714C |
| K74, S106, A342,I622,I695 | K74C, S106C, A342V, I622L, I695T |
| K74, S106, A342,I622,I695, A714 | K74C, S106C, A342V, I622L, I695T, A714C |
| A25, S43, G66, C133, C141, S128, V339, A342, V343,I622, I695 | A25V, S43C, G66C, C133S, C141S, S128C, V339G, A342V, V343C, I622L, I695T |
| A25, S43, G66, C133, C141, S128, V339, A342, V343, C498,I622, I695 | A25V, S43C, G66C, C133S, C141S, S128C, V339G, A342V, V343C, C498M, I622L, I695T |
| K74, S106, S128, A342, V343, H345,I622, I695 | K74C, S106C, S128C, A342V, V343C, H345Y, I622L, I695T |
| S43, G66, K74, S106, S128, A342, V343, H345,I622,I695 | S43C, G66C, K74C, S106C, S128C, A342V, V343C, H345Y, I622L, I695I |
| A25, K74, N90, S128, V339, A342, V343, H345, I622,I695 | A25V, K74C, N90D, S128C, V339G, A342V, V343C, H345Y, I622L, I695T |
| S43, G66, A25, K74, N90, S128, V339, A342, V343, H345,I622, I695 | S43C, G66C, A25V, K74C, N90D, S128C, V339G, A342V, V343C, H345Y, I622L, I695T |
| A25, S43, G66, K74, N90, S128,I259, C261, V339, A342, V343, H345, C498, I622, I695 | A 25 V. S43C, G66C, K74C, N90D, S128C, I259T, C261P, V339G, A342V, V343C, H345Y, C498M, I622L, I695T |
| A25, S43, G66, K74, N90, S128,I259, C261, V339, A342, V343, H345, H347, G405, C498,I622, I695 | A25V, S43C, G66C, K74C, N90D, S128C, I259T, C261P, V339G, A342V, V343C, H345Y, H347C, G405C, C498M, I622L, I695T |
| A25, L29, N90, C131, C141, A342, A386, A714 | A25V, L29F, N90D, CI 3IS, C141S, A342V, A386L, A714C |
| A25, L29, K74, N90, S106, C131, C141, A342, A3 86, A714 | A25V, L29F, K74C, N90D, S106C, C131S, C141S, A342V, A386L, A714C |

In embodiments containing an antibody Fc and hinge, combination of preferred hinges with preferred substitutions in human ACE2 (SEQ ID NO: 1) is contemplated. A lower hinge that does not contain the amino acid sequence CPA-PELL (SEQ ID NO: 2) may be desirable, because the absence of SEQ ID NO: 2 may reduce the potential for immunopathogenesis and/or antibody-dependent enhancement (ADE). For instance, an IgG2 lower hinge sequence CPAPPV (SEQ ID NO: 9), an IgG4 lower hinge sequence CPAPEFL (SEQ ID NO: 10), or substitutions that create the lower hinge sequence CPAPEAA (SEQ ID NO: 11) may be preferred in combination with the substitutions described above that promote SARS coronavirus neutralization, thermal stability, stabilize a conformation of an ACE2 mutein where substrate accessibility to the angiotensin II substrate-binding cleft is reduced (e.g., closed), form a disulfide across the homodimerization interface of the collectrin domain, and/or affect homodimerization of the collectrin domain.

In embodiments containing an antibody Fc and hinge, combining hinges containing less than two basic amino acids, e.g., exactly one basic amino acid, or zero basic amino acids, with certain substitutions in human ACE2 (SEQ ID NO: 1) is contemplated. Hinge sequences can include, e.g., an upper hinge derived from IgA1 or IgA2, which are fused to an IgG Fc, e.g., where the IgG Fc lacks the amino acid sequence CPAPELL (SEQ ID NO: 2). Hinges containing fewer than two basic residues, or containing zero basic residues, may be used in combination with the substitutions described above that promote SARS coronavirus neutralization, thermal stability, stabilize a conformation of an ACE2 mutein where substrate accessibility to the angiotensin II substrate-binding cleft is reduced (e.g., closed), form a disulfide across the homodimerization interface of the collectrin domain, and/or affect homodimerization of the collectrin domain.

In certain embodiments, a fusion protein comprises a protein sequence set forth at SEQ ID NO: 28-55, 58, 60, 62, 64, 66, 125, 127, 129, or 130. In certain embodiments, a fusion protein is encoded by a nucleic acid sequence set forth at SEQ ID NO: 56, 57, 59, 61, 63, 65, 67, 68, 126, or 128.

L. Signal Sequence

Substitutions, insertions, and deletions in the signal sequence for secretion in the endoplasmic reticulum (ER) of human ACE2 (SEQ ID NO: 1), corresponding to amino acid positions 1-18, may be used in combination with the substitutions described above that promote SARS coronavirus neutralization, thermal stability, stabilize a conformation of an ACE2 mutein where substrate accessibility to the angiotensin 11 substrate-binding cleft is reduced (e.g., closed), form a disulfide across the homodimerization interface of the collectrin domain, and/or affect homodimerization of the collectrin domain. It has been discovered that different signal peptides, e.g., the signal peptide of CD5, improves the expression of ACE2 muteins. Thus, substitutions, insertions, and deletions at positions 1-18 of human ACE2 (SEQ ID NO: 1) can be used in combination with the substitutions described above that promote SARS coronavirus neutralization, thermal stability, stabilize a conformation of an ACE2 mutein where the angiotensin II substrate-binding cleft is closed, form a disulfide across the homodimerization interface of the collectrin domain, affect homodimerization of the collectrin domain, lack the lower hinge sequence CPAPELL (SEQ ID NO: 2), and/or have fewer than two basic amino acids in the hinge.

In certain embodiments, an ACE2 mutein can comprise a signal peptide. In certain embodiments, the signal peptide comprises amino acids 1-18 of wild-type human ACE2 (SEQ ID NO: 1), wherein one or more amino acid substitutions, insertions, or deletions is present therein. For example, 1, 2, 3, 4, 5, 6, 7, 8, 9, or 10 amino acid substitutions, insertions, or deletions may be present therein. In certain embodiments, an ACE2 mutein can comprise a non-ACE2 signal peptide sequence, e.g., a CD5 signal sequence. In certain embodiments, the signal peptide is between about 5 and about 20 amino acids, e.g., between about 5 and about 15 amino acids, between about 5 and about 10 amino acids, between about and about 20 amino acids, or between about 10 and about 15 amino acids in length. In certain embodiments, the signal sequence is positioned at the N-terminus of the mutein. In certain embodiments, there are no intervening amino acids between the signal peptide and the N-terminal portion of the ACE2 mutein, e.g., N-terminal portion of the ACE2 mutein that corresponds to amino acids 19-615 of wild-type human ACE2 (SEQ ID NO: 1). In certain embodiments, the signal peptide is functional, i.e., can translocate the ACE2 mutein as determined by an assay for protein expression, for example, as shown in Example 5.

M. Fusion Proteins Comprising Antibody Fc Domains

The disclosure further relates to proteins comprising an ACE2 mutein and an antibody Fc domain.

As used herein, unless otherwise indicated, the term "antibody Fc domain" or "immunoglobulin Fc domain" or "Fc domain" or "Fc" refers to a fragment of an immunoglobulin heavy chain constant region which, either alone or in combination with a second immunoglobulin Fc domain, or unconjugated or conjugated to an ACE2 mutein, is capable of binding to an Fc receptor. An immunoglobulin Fc domain may include, e.g., immunoglobulin CH2 and CH3 regions. An immunoglobulin Fc domain may include, e.g., immunoglobulin CH2 and CH3 regions and an immunoglobulin hinge region. Boundaries between immunoglobulin hinge regions, CH2, and CH3 regions are well known in the art, and can be found, e.g., in the PROSITE database (available on the world wide web at prosite.expasy.org).

In certain embodiments, the immunoglobulin Fc domain is derived from a human IgG1, IgG2, IgG3, IgG4, IgA1, IgA2, IgD, IgE, and IgM Fc domain. A single amino acid substitution (S228P according to Kabat numbering, designated IgG4Pro) may be introduced to abolish the heterogeneity observed in recombinant IgG4 antibody. See Angal, S. et al. (1993) Mol. Immunol. 30:105-108.

In certain embodiments, the immunoglobulin Fc domain is derived from a human IgG1 isotype or another isotype that elicits antibody-dependent cell-mediated cytotoxicity (ADCC) and/or complement mediated cytotoxicity (CDC). In certain embodiments, the immunoglobulin Fc domain is derived from a human IgG1 isotype.

In certain embodiments, the immunoglobulin Fc domain is derived from a human IgG4 isotype or another isotype that elicits little or no antibody-dependent cell-mediated cytotoxicity (ADCC) and/or complement mediated cytotoxicity (CDC). In certain embodiments, the immunoglobulin Fc domain is derived from a human IgG4 isotype.

In certain embodiments, the immunoglobulin Fc domain comprises either a "knob" mutation, e.g., T366Y or a "hole" mutation, e.g., Y407T for heterodimerization with a second polypeptide (residue numbers according to EU numbering, Kabat, E. A., et al. (1991) Sequences of Proteins of Immunological Interest, Fifth Edition, U.S. Department of Health and Human Services, NIH Publication No. 91-3242). In certain embodiments comprising an ACE2 mutein-Fc fusion with two Fc domains, the first Fc domain can comprise a "knob" mutation and the second Fc domain can comprise a "hole" mutation.

In certain embodiments, as shown in FIG. 1A, the protein comprises an ACE2 mutein and an Fc region including a hinge (e.g., a hinge selected from SEQ ID NOs: 2-11) and the CH2 and CH3 regions of an immunoglobulin (e.g., a human immunoglobulin). In certain embodiments, as shown, for example, in FIG. 1A, the protein dimerizes by disulfide bond formation between two hinge regions.

In certain embodiments, as shown in FIG. 1B, the protein comprises an ACE2 mutein, a collectrin domain, and an Fc region including a hinge (e.g., a hinge selected from SEQ ID NOs: 2-11) and the CH2 and CH3 regions of an immunoglobulin (e.g., a human immunoglobulin). In certain embodiments, as shown for example in FIG. 1B, the protein dimerizes by disulfide bond formation between two hinge regions.

In certain embodiments, the disclosure relates to a protein comprising a human ACE2 mutein comprising an amino acid sequence at least 80% identical to wild-type human ACE2 (SEQ ID NO: 1) or at least 80% identical to amino acids 19-615 of wild-type human ACE2 (SEQ ID NO: 1), and an antibody Fc domain comprising a hinge comprising at least one cysteine. In certain embodiments, the hinge does not comprise the amino acid sequence CPAPELL (SEQ ID NO: 2).

In certain embodiments, the amino acid sequence of human ACE2 (SEQ ID NO: 1) or the amino acid sequence of the collectrin domain of human ACE2 and the amino acid sequence of the hinge are joined at an amino acid that is the same in each sequence to form a junction. Exemplary junction sequences include SEQ ID NOs: 12-15.

For example, the disclosure relates to a fusion protein comprising an ACE2 mutein fused to an IgG1 hinge sequence EPKSSDKTHTCPPCPAPELL (amino acids 2-21 of SEQ ID NO: 5), with a natural IgG1 Fc disposed C-terminally to this IgG1 hinge sequence, e.g., SEQ ID NO: 30. In certain embodiments, a fusion protein composing an ACE2 mutein comprises an IgA1 upper hinge disposed between the ACE2 mutein and the IgG1 hinge, e.g., SEQ ID NO: 31.

In certain embodiments, a fusion protein comprises an ACE2 mutein and an IgG2 hinge sequence CCVECPPCPAPPVA (amino acids 9-22 of SEQ ID NO: 6) or an IgG2 hinge sequence VECPPCPAPPVA (amino acids 11-22 of SEQ ID NO: 6).

In certain embodiments, an IgA1 upper hinge is disposed between the ACE2 mutein and the IgG2 hinge sequence, e.g., SEQ ID NOs: 28-29, and 32-53. In certain embodiments, a fusion protein comprises an ACE2 mutein and an IgA1 hinge, which lacks basic residues and is longer in length in comparison to other human antibody hinges. The junction of the ACE2 mutein and IgA1 hinge may optionally form a potential O-linked glycan site (overlapping the C-terminus of the ACE2 mutein and the N-terminus of the IgA1 hinge), e.g., SEQ ID NOs: 32-52. For example, amino acids 617 and 740 of human ACE2 (SEQ ID NO: 1) are both serine amino acids. Because ACE2 fragments terminating at amino acid 617 or 740 terminate in a serine amino acid, the C-terminal end of the ACE2 mutein can be blended with the hinge of an IgA1 such that the junction between the ACE2 mutein and the IgA1 upper hinge is a naturally-occurring potential O-linked glycosylation site present in IgA. Thus, S617 or S740 of the ACE2 mutein can be the N-terminal serine of the IgA1 hinge region sequence STPPTPSPSC, STPPTPSPSCC, STPPTPSPSTPPTPSPSC, or STPPTPSP-STPPTPSPSCC (amino acids 12-21, 12-22, 4-21, or 4-22 respectively, of the IgA1 hinge, SEQ ID NO: 3), and thereby form part of a potential O-linked glycosylation motif at the junction between the collectrin domain and the IgA1 hinge. The junction between the IgA1 hinge and the IgG2 hinge can be designed such that the sequences of the IgA1 and IgG2 hinges overlap by one or two amino acids, e.g., overlap by the two N-terminal cysteines of the IgG2 hinge sequence CCVECPPCPAPPVA (amino acids 9-22 of SEQ ID NO: 6) as in SEQ ID NOs: 38, 40, 41, 54-55, or overlap by the N-terminal cysteine of CPPCPAPPVA (amino acids 13-22 of SEQ ID NO: 6) as in SEQ ID NOs: 37, 39, and 46-53.

In certain embodiments, seven to twenty amino acids are disposed between the N-terminal cysteine of said hinge and amino acid 613 based on the consecutive numbering of amino acid positions in the ACE2 mutein in SEQ ID NO: 1. For example, seven to ten, seven to fifteen, seven to twenty, seven to fifteen, seven to twenty, ten to fifteen, ten to twenty, ten to fifteen, ten to twenty, or fifteen to twenty amino acids can exist between the N-terminal cysteine of said hinge and amino acid 613 based on the consecutive numbering of amino acid positions in the ACE2 mutein in SEQ ID NO: 1.

In certain embodiments, nine to twenty amino acids are disposed between the N-terminal cysteine of said hinge and amino acid 725 based on the consecutive numbering of amino acid positions in wild-type human ACE2 (SEQ ID NO: 1). For example, nine to fifteen, nine to twenty, or fifteen to twenty amino acids can be disposed between the N-terminal cysteine of said hinge and amino acid 725 based on the consecutive numbering of amino acid positions in wild-type human ACE2 (SEQ ID NO: 1).

In certain embodiments, none of the six amino acids immediately preceding, in an N-to-C direction, the N-terminal cysteine of the hinge are leucine, isoleucine, valine, methionine, proline, phenylalanine, or tryptophan. In certain embodiments, none of the six amino acids immediately preceding, in an N-to-C direction, the N-terminal cysteine of the hinge are leucine, isoleucine, valine, methionine, proline, or phenylalanine. In certain embodiments, none of the six amino acids immediately preceding, in an N-to-C direction, the N-terminal cysteine of the hinge are leucine, isoleucine, valine, methionine, or proline. In certain embodiments, none of the six amino acids immediately preceding, in an N-to-C direction, the N-terminal cysteine of the hinge are leucine, isoleucine, valine, or methionine. In certain embodiments, none of the six amino acids immediately preceding, in an N-to-C direction, the N-terminal cysteine of the hinge are leucine, isoleucine, valine, or methionine. In certain embodiments, none of the six amino acids immediately preceding, in an N-to-C direction, the N-terminal cysteine of the hinge are leucine or isoleucine valine. In certain embodiments, none of the six amino acids immediately preceding, in an N-to-C direction, the N-terminal cysteine of the hinge are isoleucine, valine, methionine, proline, phenylalanine, or tryptophan. In certain embodiments, none of the six amino acids immediately preceding, in an N-to-C direction, the N-terminal cysteine of the hinge are valine, methionine, proline, phenylalanine, or tryptophan. In certain embodiments, none of the six amino acids immediately preceding, in an N-to-C direction, the N-terminal cysteine of the hinge are methionine, proline, phenylalanine, or tryptophan. In certain embodiments, none of the six amino acids immediately preceding, in an N-to-C direction, the N-terminal cysteine of the hinge are proline, phenylalanine, or tryptophan. In certain embodiments, none of the six amino acids immediately preceding, in an N-to-C direction, the N-terminal cysteine of the hinge are phenylalanine or tryptophan. In certain embodiments, none of the six amino acids immediately preceding, in an N-to-C direction, the N-terminal cysteine of the hinge is leucine. In certain embodiments, none of the six amino acids immediately preceding, in an N-to-C direction, the N-terminal cysteine of the hinge is isoleucine. In certain embodiments, none of the six amino acids immediately preceding, in an N-to-C direction, the N-terminal cysteine of the hinge is valine. In certain embodiments, none of the six amino acids immediately preceding, in an N-to-C direction, the N-terminal cysteine of the hinge is methionine. In certain embodiments, none of the six amino acids immediately preceding, in an N-to-C direction, the N-terminal cysteine of the hinge is proline. In certain embodiments, none of the six amino acids immediately preceding, in an N-to-C direction, the N-terminal cysteine of the hinge is phenylalanine. In certain embodiments, none of the six amino acids immediately preceding, in an N-to-C direction, the N-terminal cysteine of the hinge is tryptophan.

In certain embodiments, the hinge is linked to the ACE2 mutein by an amino acid sequence comprising at least one of the potential O-linked glycosylation sites SS, ST, TS, TT, or at least one of the potential N-linked glycosylation sites NXS, NXT, NNSS (SEQ ID NO: 16), NNST (SEQ ID NO: 17), NNTS (SEQ ID NO: 18), or NNTT (SEQ ID NO: 19), wherein X is any amino acid.

In certain embodiments, the hinge comprises the sequence CPAPPV (SEQ ID NO: 9), CPAPEFL (SEQ ID NO: 10), or CPAPEAA (SEQ ID NO: 11).

In certain embodiments, the hinge is glycosylated.

II. Protein Production

Methods for producing proteins of the invention are known in the art. For example, DNA molecules encoding a protein comprising an ACE2 mutein can be chemically synthesized using the sequence information provided herein, for example, the wild-type sequence of the and other sequences known in the art. Synthetic DNA molecules can be ligated to other appropriate nucleotide sequences, including, e.g., expression control sequences, to produce conventional gene expression constructs encoding the desired protein.

Nucleic acids encoding a desired protein comprising a ACE2 mutein can be incorporated (ligated) into expression vectors, which can be introduced into host cells through conventional transfection or transformation techniques.

Transformed host cells can be grown under conditions that permit the host cells to express the genes that encode the protein.

Nucleic acids encoding a ACE2 mutein may be generated by mutating a nucleotide sequence encoding the wild-type human ACE2 (SEQ ID NO: 1) with or without the collectrin domain of human ACE2 (e.g., amino acids 616-723 of SEQ ID NO: 1) using methods known in the art. The DNA sequence encoding wild-type human ACE2 is known in the art and an mRNA sequence encoding wild-type human ACE2 is provided at SEQ ID NO: 56. Furthermore, in certain embodiments, nucleic acids encoding a protein of the invention may be codon optimized for expression in a heterologous cell, e.g., an E. coli cell, CHO cell, etc., using methods known in the art.

In certain embodiments, a nucleic acid sequence encoding an ACE2 mutein can be altered to remove one or more cryptic splice sites (e.g., a splice acceptor site). For example, a cryptic splice acceptor occurs in the codon corresponding to T609 of human wild-type ACE2 (SEQ ID NO: 1). T609 is encoded by the codon ACA, which forms a CAG splice acceptor consensus motif with the G of the GA(T/C) codon encoding the adjacent amino acid D610. To avoid a cryptic splice site, a codon encoding T609 can be designed in which the second position is not a T or a C and the third position is not an A to encode for the amino acid corresponding to T609 of human ACE2 (SEQ ID NO: 1).

In certain embodiments wherein a ACE2 mutein comprises a collectrin domain, the nucleic acid sequence may be altered to remove one or more cryptic splice sites (e.g., a splice acceptor site). For example, in certain embodiments, a cryptic splice acceptor site at the AG splice acceptor dinucleotide motif of the AGA codon encoding R697 can be eliminated by using a CCA or CCG codon rather than CCC or CCT codon to encode the P696 amino acid (to avoid creating a CAG or TAG splice acceptor motif). In certain embodiments, the codon CGC, CGT, CGA, or CGG can be used instead of an AGA or AGG codon to encode R697.

The introduction of certain substitutions can inadvertently introduce cryptic splice donor or acceptor sequences. For example, introduction of the substitution A25V resulted in the creation of a functional splice donor sequence, as shown in FIG. 20 and described in the examples herein. Specifically, the "AG" nucleotides of the codon CAG, which encodes Q24, together with the "GT" nucleotides of the valine codon GTN (where N is C, T, A, or G) at position 25, formed the splice donor motif GGT (or AGGT). Accordingly, the disclosure further relates to nucleic acid sequences encoding an A25V substitution, wherein the nucleic acid does not comprise a CAG codon at the position corresponding to Q24 of human ACE2 (SEQ ID NO: 1). When A25V is present, Q24 can be encoded by, for example, the codon CAA. The nucleotide "T" is recited herein in reference to codons present in DNA. However, as the skilled artisan recognizes, a "U" nucleotide is substituted in place of a "T" nucleotide in RNA.

In certain embodiments, the nucleic acid encoding the ACE2 mutein can comprise one or more introns, such as an HTLV-1 intron or an SV40 intron. In certain embodiments, an intron sequence may be located 5' to the start codon of the ACE coding sequence. In certain embodiments, an intron sequence may be located between the codons encoding K619 and V620.

In certain embodiments, the nucleotide sequence encoding the ACE2 mutein comprises at least two exons separated by at least one intron. In certain embodiments, the nucleotide sequence encoding the ACE2 mutein comprises at least two introns. In certain embodiments, inclusion or at least one intron or at least two introns in a nucleic acid encoding an ACE2 mutein increases the expression (e.g., the yield) of the ACE2 mutein.

Specific expression and purification conditions will vary depending upon the expression system employed. For example, if a gene is to be expressed in E. coli, it can be cloned into an expression vector by positioning the engineered gene downstream from a suitable bacterial promoter, e.g., Trp or Tac, and a prokaryotic signal sequence. The expressed secreted protein accumulates in refractile or inclusion bodies, and can be harvested after disruption of the cells by French press or sonication. The refractile bodies then are solubilized, and the proteins refolded and cleaved by methods known in the art.

A protein can be produced by growing (culturing) a host cell transfected with an expression vector encoding such protein, under conditions that permit expression of the protein. Following expression, the protein can be harvested and purified or isolated using techniques known in the art, e.g., Protein A purification.

In certain embodiments, a protein, e.g., an ACE2 mutein or a protein comprising an ACE2 mutein, is manufactured in the presence of a small molecule inhibitor of ACE2, e.g., MLN-4760. Accordingly, the disclosure relates in part to method of manufacturing a mutein, a fusion protein, or a protein as described herein, comprising contacting the mutein, fusion protein or protein with a small molecule inhibitor of ACE2, e.g., MLN-4760.

III. Pharmaceutical Compositions

For therapeutic use, a protein disclosed herein preferably is combined with a pharmaceutically acceptable carrier. The term "pharmaceutically acceptable" as used herein refers to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

The term "pharmaceutically acceptable carrier" as used herein refers to buffers, carriers, and excipients suitable for use in contact with the tissues of human beings and animals without excessive toxicity, irritation, allergic response, or other problem or complication, commensurate with a reasonable benefit/risk ratio. Pharmaceutically acceptable carriers include any of the standard pharmaceutical carriers, such as a phosphate buffered saline solution, water, emulsions (e.g., such as an oil/water or water/oil emulsions), and various types of wetting agents. The compositions also can include stabilizers and preservatives. For examples of carriers, stabilizers and adjuvants, see, e.g., Martin, Remington's Pharmaceutical Sciences, 15th Ed., Mack Publ. Co., Easton, PA [1975]. Pharmaceutically acceptable carriers include buffers, solvents, dispersion media, coatings, isotonic and absorption delaying agents, and the like, that are compatible with pharmaceutical administration. The use of such media and agents for pharmaceutically active substances is known in the art.

In certain embodiments, a pharmaceutical composition may contain formulation materials for modifying, maintaining or preserving, for example, the pH, osmolarity, viscosity, clarity, color, isotonicity, odor, sterility, stability, rate of dissolution or release, adsorption or penetration of the composition. In such embodiments, suitable formulation materials include, but are not limited to, amino acids (such as glycine, glutamine, asparagine, arginine or lysine); antimicrobials; antioxidants (such as ascorbic acid, sodium sulfite or sodium hydrogen-sulfite); buffers (such as borate, bicarbonate, Tris-HCl, citrates, phosphates or other organic acids); bulking agents (such as mannitol or glycine); chelating agents (such as ethylenediamine tetraacetic acid (EDTA)); complexing agents (such as caffeine, polyvinylpyrrolidone, beta-cyclodextrin or hydroxypropyl-beta-cyclodextrin); fillers; monosaccharides; disaccharides; and other carbohydrates (such as glucose, mannose or dextrins); proteins (such as serum albumin, gelatin or immunoglobulins); coloring, flavoring and diluting agents; emulsifying agents; hydrophilic polymers (such as polyvinylpyrrolidone); low molecular weight polypeptides; salt-forming counterions (such as sodium); preservatives (such as benzalkonium chloride, benzoic acid, salicylic acid, thimerosal, phenethyl alcohol, methylparaben, propylparaben, chlorhexidine, sorbic acid or hydrogen peroxide); solvents (such as glycerin, propylene glycol or polyethylene glycol); sugar alcohols (such as mannitol or sorbitol); suspending agents; surfactants or wetting agents (such as pluronics, PEG, sorbitan esters, polysorbates such as polysorbate 20, polysorbate, triton, tromethamine, lecithin, cholesterol, tyloxapal); stability enhancing agents (such as sucrose or sorbitol); tonicity enhancing agents (such as alkali metal halides, preferably sodium or potassium chloride, mannitol sorbitol); delivery vehicles; diluents; excipients and/or pharmaceutical adjuvants (See *Remington's Pharmaceutical Sciences,* 18th ed. (Mack Publishing Company, 1990).

In certain embodiments, a pharmaceutical composition may contain nanoparticles, e.g., polymeric nanoparticles, liposomes, or micelles (See Anselmo et al. (2016) BIOENG. TRANSL. MED. 1: 10-29).

In certain embodiments, a pharmaceutical composition may contain a sustained- or controlled-delivery formulation. Techniques for formulating sustained- or controlled-delivery means, such as liposome carriers, bio-erodible microparticles or porous beads and depot injections, are also known to those skilled in the art. Sustained-release preparations may include, e.g., porous polymeric microparticles or semipermeable polymer matrices in the form of shaped articles, e.g., films, or microcapsules. Sustained release matrices may include polyesters, hydrogels, polylactides, copolymers of L-glutamic acid and gamma ethyl-L-glutamate, poly (2-hydroxyethyl-inethacrylate), ethylene vinyl acetate, or poly-D (–)-3-hydroxybutyric acid. Sustained release compositions may also include liposomes that can be prepared by any of several methods known in the art.

Pharmaceutical compositions containing a protein disclosed herein can be presented in a dosage unit form and can be prepared by any suitable method. A pharmaceutical composition should be formulated to be compatible with its intended route of administration. Examples of routes of administration are intravenous (IV), subcutaneous, intradermal, inhalation, transdermal, topical, transmucosal, intrathecal and rectal administration. An exemplary route of administration is IV infusion. Useful formulations can be prepared by methods known in the pharmaceutical art. For example, see *Remington's Pharmaceutical Sciences,* 18th ed. (Mack Publishing Company, 1990). Formulation components suitable for parenteral administration include a sterile diluent such as water for injection, saline solution, fixed oils, polyethylene glycols, glycerin, propylene glycol or other synthetic solvents; antibacterial agents such as benzyl alcohol or methyl parabens; antioxidants such as ascorbic acid or sodium bisulfite; chelating agents such as EDTA; buffers such as acetates, citrates or phosphates; and agents for the adjustment of tonicity such as sodium chloride or dextrose.

For intravenous administration, suitable carriers include physiological saline, bacteriostatic water, Cremophor ELTM (BASF, Parsippany, NJ) or phosphate buffered saline (PBS). The carrier should be stable under the conditions of manufacture and storage, and should be preserved against microorganisms. The carrier can be a solvent or dispersion medium containing, for example, water, ethanol, polyol (for example, glycerol, propylene glycol, and liquid polyethylene glycol), and suitable mixtures thereof.

Pharmaceutical formulations preferably are sterile. Sterilization can be accomplished by any suitable method, e.g., filtration through sterile filtration membranes. Where the composition is lyophilized, filter sterilization can be conducted prior to or following lyophilization and reconstitution.

The compositions described herein may be administered locally or systemically. In certain embodiments, administration will be parenteral administration. In certain embodiments, the pharmaceutical composition is administered subcutaneously, and in certain embodiments intravenously. Preparations for parenteral administration include sterile aqueous or non-aqueous solutions, suspensions, and emulsions.

In certain embodiments, a therapeutically effective amount of active component is in the range of 0.1 mg/kg to 100 mg/kg, e.g., 1 mg/kg to 100 mg/kg, 1 mg/kg to 50 mg/kg, 1 mg/kg to 40 mg/kg, 1 mg/kg to 30 mg/kg, 1 mg/kg to 20 mg/kg, 1 mg/kg to 10 mg/kg, 1 mg/kg to 5 mg/kg, 50 mg/kg, 40 mg/kg, 30 mg/kg, 20 mg/kg, 10 mg/kg, 7.5 mg/kg, 5 mg/kg, or 2.5 mg/kg. The amount administered will depend on variables such as the type and extent of disease or indication to be treated, the overall health of the patient, the in vivo potency of the active component, the pharmaceutical formulation, and the route of administration. The initial dosage can be increased beyond the upper level in order to rapidly achieve the desired blood-level or tissue-level. Alternatively, the initial dosage can be smaller than the optimum, and the daily dosage may be progressively increased during the course of treatment. Human dosage can be optimized, e.g., in a conventional Phase I dose escalation study designed to run from 0.5 mg/kg to 30 mg/kg. Dosing frequency can vary, depending on factors such as route of administration, dosage amount, plasma half-life, and the disease being treated. Exemplary dosing frequencies are once per day, once per week, once every two weeks, once per month, once every two months, and once every three months. An exemplary route of administration is parenteral, e.g., intravenous infusion. In certain embodiments, the protein is administered subcutaneously. In certain embodiments, the protein or is lyophilized, and then reconstituted in buffered saline, at the time of administration. In certain embodiments, the protein is administered using a nebulizer.

In certain embodiments, the pharmaceutical composition comprises an ACE2 mutein and an ACE2 inhibitor, such as a small molecule ACE2 inhibitor. In certain embodiments, the ACE2 mutein comprises at least two cysteine substitutions.

IV. Therapeutic Uses

The proteins, compositions, and methods disclosed herein can be used to treat infection with SARS-CoV, SARS-CoV-2, or HCoV-NL63 in a subject. The proteins also may be used to treat infection by coronaviruses that cross into the human population by zoonotic transmission from an animal host in the future, and thus may be useful in future epidemics or pandemics. The method comprises administering to the subject an effective amount of a protein or pharmaceutical composition disclosed herein, either alone or in a combination with another therapeutic agent, to treat the coronavirus infection in the subject. The invention also provides a method of blocking the entry of SARS-CoV, SARS-CoV-2, or HCoV-NL63 into a host cell, e.g., a human host cell. The invention also provides a method of preventing the S protein of a SARS coronavirus from binding to endogenous ACE2. The invention also provides a method of treating the acute respiratory distress that is a hallmark of SARS coronavirus infection.

The term "effective amount" as used herein refers to the amount of an active agent (e.g., a protein comprising a ACE2 mutein according to the present invention) sufficient to effect beneficial or desired results. An effective amount can be administered in one or more administrations, applications or dosages and is not intended to be limited to a particular formulation or administration route.

As used herein, "treat", "treating" and "treatment" mean the treatment of a disease in a subject, e.g., in a human. This includes: (a) inhibiting the disease, i.e., arresting its development; and (b) relieving the disease, i.e., causing regression of the disease state. As used herein, the terms "subject" and "patient" refer to an organism to be treated by the methods and compositions described herein. Such organisms preferably include, but are not limited to, mammals (e.g., murines, simians, equines, bovines, porcines, canines, felines, and the like), and more preferably includes humans.

The methods and compositions described herein can be used alone or in combination with other therapeutic agents and/or modalities. The term administered "in combination," as used herein, is understood to mean that two (or more) different treatments are delivered to the subject during the course of the subject's affliction with the disorder, such that the effects of the treatments on the patient overlap at a point in time. In certain embodiments, the delivery of one treatment is still occurring when the delivery of the second begins, so that there is overlap in terms of administration. This is sometimes referred to herein as "simultaneous" or "concurrent delivery." In other embodiments, the delivery of one treatment ends before the delivery of the other treatment begins. In certain embodiments of either case, the treatment is more effective because of combined administration. For example, the second treatment is more effective, e.g., an equivalent effect is seen with less of the second treatment, or the second treatment reduces symptoms to a greater extent, than would be seen if the second treatment were administered in the absence of the first treatment, or the analogous situation is seen with the first treatment. In certain embodiments, delivery is such that the reduction in a symptom, or other parameter related to the disorder is greater than what would be observed with one treatment delivered in the absence of the other. The effect of the two treatments can be partially additive, wholly additive, or greater than additive. The delivery can be such that an effect of the first treatment delivered is still detectable when the second is delivered.

In certain embodiments, a method or composition described herein is administered in combination with a nuclease analog or a protease inhibitor (e.g., remdesivir), monoclonal antibodies directed against one or more SARS coronaviruses, a vaccine against one or more SARS coronaviruses, an immunosuppressant or anti-inflammatory drug (e.g., dexamethasone, sarilumab or tocilizumab), ACE inhibitors, vasodilators, or any combination thereof.

Throughout the description, where compositions are described as having, including, or comprising specific components, or where processes and methods are described as having, including, or comprising specific steps, it is contemplated that, additionally, there are compositions of the present invention that consist essentially of, or consist of, the recited components, and that there are processes and methods according to the present invention that consist essentially of, or consist of, the recited processing steps.

In the application, where an element or component is said to be included in and/or selected from a list of recited elements or components, it should be understood that the element or component can be any one of the recited elements or components, or the element or component can be selected from a group consisting of two or more of the recited elements or components.

Further, it should be understood that elements and/or features of a composition or a method described herein can be combined in a variety of ways without departing from the spirit and scope of the present invention, whether explicit or implicit herein. For example, where reference is made to a particular compound, that compound can be used in various embodiments of compositions of the present invention and/or in methods of the present invention, unless otherwise understood from the context. In other words, within this application, embodiments have been described and depicted in a way that enables a clear and concise application to be written and drawn, but it is intended and will be appreciated that embodiments may be variously combined or separated without parting from the present teachings and invention(s). For example, it will be appreciated that all features described and depicted herein can be applicable to all aspects of the invention(s) described and depicted herein.

It should be understood that the expression "at least one of" includes individually each of the recited objects after the expression and the various combinations of two or more of the recited objects unless otherwise understood from the context and use. The expression "and/or" in connection with three or more recited objects should be understood to have the same meaning unless otherwise understood from the context.

The use of the term "include," "includes," "including," "have," "has," "having," "contain," "contains," or "containing," including grammatical equivalents thereof, should be understood generally as open-ended and non-limiting, for example, not excluding additional unrecited elements or steps, unless otherwise specifically stated or understood from the context.

Where the use of the term "about" is before a quantitative value, the present invention also includes the specific quantitative value itself, unless specifically stated otherwise. As used herein, the term "about" refers to a ±10% variation from the nominal value unless otherwise indicated or inferred.

It should be understood that the order of steps or order for performing certain actions is immaterial so long as the present invention remain operable. Moreover, two or more steps or actions may be conducted simultaneously.

The use of any and all examples, or exemplary language herein, for example, "such as" or "including," is intended merely to illustrate better the present invention and does not pose a limitation on the scope of the invention unless claimed. No language in the specification should be construed as indicating any non-claimed element as essential to the practice of the present invention.

EXAMPLES

The following examples are merely illustrative and are not intended to limit the scope or content of the invention in any way.

Example 1—Stabilization of the Hydrophobic Interior of ACE2

A novel protein engineering strategy was implemented, which is based on stabilizing the hydrophobic interior of the protein. This strategy is pursued by filling empty spaces within the hydrophobic interior of the protein by substituting buried amino acids with hydrophobic or aromatic amino acids having more carbon atoms or a greater molecular weight than the amino acid that is replaced. The intent of this approach to protein engineering is to stabilize the protein, e.g., to increase its thermal stability, which is used a surrogate for its developability as a pharmaceutical product, shelf life, and half-live in vivo. Without the intention of being limited by any particular theory, this approach may increase the energetic cost of protein unfolding by eliminating energetically-unfavorable empty spaces within the hydrophobic interior of the protein. Thus, a mutein engineered through this approach may present a higher energetic barrier to protein unfolding than the wild-type protein from which it was engineered. The thermodynamic principle behind this approach can be summed up with the aphorism "nature abhors a vacuum."

This approach was applied to ACE2, the receptor for SARS coronaviruses. Empty spaces within the hydrophobic interior of ACE2 can be visualized in three-dimensional representations of structural data. Empty spaces were filled or partially filled with one or more substitutions of a buried amino acid in wild-type human ACE2 (SEQ ID NO: 1) by a hydrophobic or aromatic amino acid having more carbon atoms or a greater molecular weight than the amino acid that is replaced. Relying on this strategy of filling empty spaces within the hydrophobic interior of ACE2 with hydrophobic or aromatic amino acids having more carbon atoms or greater molecular weights than the amino acids being replaced has improved the stability of ACE2 muteins.

In several instances, an interior empty space exists near the interface between the surface of ACE2 and its interior. For instance, the side chain of an amino acid may have the interior of ACE2 on one side, and the exterior of ACE2 on the other side. In certain cases, a partially-buried serine can be replaced by a threonine to fill a space in the hydrophobic interior of ACE2.

It was hypothesized that stabilizing the hydrophobic interior of ACE2 near where ACE2 contacts the RBD of SARS coronavirus S proteins (i.e., the region from S19-S106 and P336-M360 of SEQ ID NO: 1) might improve binding affinity for the RBD and neutralization of SARS coronaviruses. Specifically, it was hypothesized that replacing buried amino acids in the region from S19-S106 and P336-M360 of wild-type human ACE2 with hydrophobic or aromatic amino acids having more carbon atoms or greater molecular weights than the amino acids being replaced would fill spaces within the hydrophobic interior of the protein, thereby increasing the stability of RBD contacts.

Structures of ACE2 bound to the RBD of SARS-CoV-1 (e.g., Protein Data Bank structures: 6ACG, 6ACJ and 6ACK), and SARS-CoV-2 (e.g., Protein Data Bank structures: 6M17, 6M18, and 6M 1 D) were examined. These structures were used to identify empty spaces that exist within the hydrophobic interior of ACE2 when it is bound to SARS coronavirus S proteins, in order to fill these spaces by replacing buried amino acids with hydrophobic or aromatic amino acid having more carbon atoms or a greater molecular weight than the amino acid that is replaced. Furthermore, the structures of SARS coronavirus RBD-bound ACE2 proteins were compared to structures of native ACE2 (e.g., 1R42) to identify substitutions that might stabilize the RBD-bound conformation. With this purpose in mind, computer software was developed for visualizing empty spaces within the structure of ACE2, and for modeling potential steric clashes for all possible rotamers of substitutions that replace a buried amino acid with hydrophobic or aromatic amino acid having more carbon atoms or a greater molecular weight than the amino acid that is replaced.

An analysis of ACE2 structures, aided by computer software written specifically for this purpose, suggested several potential substitutions for an initial evaluation of the hypothesis that could stabilize the conformation of ACE2 recognized by SARS coronaviruses. The analyses focused on the region of ACE2 proximal to the RBD, e.g., position S19-S106 and P336-M360 of SEQ ID NO: 1. These potential substitutions included: A25V, A25L, A36L, A80V, 188F, L97F, and A342V.

Certain ACE2 muteins were constructed by fusing amino acids 1-615, 1-617, or 1-740 onto the upper hinge of an antibody Fc. Other ACE2 muteins were constructed by cloning a coding region encoding amino acids 19-615, 19-617, or 19-740 into a plasmid that encoded a CD5 signal peptide at the 5' end and an antibody Fc at the 3' end. IgG1 variants were cloned containing amino acids 19-615 fused to the IgG1 Fc hinge sequence EPKSSDKTHTCPPCPAPELL (amino acids 2-21 of SEQ ID NO: 5), with a natural IgG1 Fc located C-terminal to this IgG1 hinge sequence, e.g., SEQ ID NO: 30. Alternatively, an IgA1 upper hinge was inserted in between the ACE2 mutein and the IgG1 hinge, e.g., SEQ ID NO: 31. IgG2 variants were constructed by cloning a coding region encoding amino acids 19-615, 19-617, or 19-740 onto the IgG2 hinge sequence CCVECPPCPAPPVA (amino acids 9-22 of SEQ ID NO: 6) or the IgG2 hinge sequence VECPPCPAPPVA (amino acids 11-22 of SEQ ID NO: 6). Typically, an IgA1 upper hinge was inserted in between the ACE2 mutein and the IgG2 hinge sequence, e.g., SEQ ID NOs: 28-29, and 31-53. The rationale for using an IgA1 hinge was the absence of basic residues, longer length in comparison to other human antibody hinges, and optionally a potential O-linked glycan site overlapping the C-terminal end of the ACE2 mutein and N-terminal beginning of the IgA1 hinge, e.g., SEQ ID NOs: 32-52. For instance, amino acid numbers 617 and 740 of human ACE2 (SEQ ID NO: 1) are both serine amino acids. Because ACE2 fragments terminating at amino acid 617 or 740 terminate in a serine amino acid, the C-terminal end of the ACE2 mutein can be blended with the hinge of an IgA1 such that the junction between the ACE2 mutein and the IgA1 upper hinge is a naturally-occurring potential O-linked glycosylation site present in IgA1. Thus, S617 or S740 of the ACE2 mutein can be the N-terminal serine of the IgA1 hinge region sequence STPPTPSPSC, STPPTPSPSCC, STPPTPSPSTPPTPSPSC, or STPPTPSPSTPPTPSPSCC (amino acids 12-21, 12-22, 4-21, or 4-22 respectively, of the IgA1 hinge, SEQ ID NO: 3), and thereby form part of a potential O-linked glycosylation motif at the junction between the collectrin domain and the IgA1 hinge. The junction between the IgA1 hinge and the IgG2 hinge was typically designed such that the sequences of the IgA1 and IgG2 hinges overlapped by one or two amino acids, e.g., overlapping by the two N-terminal cysteines of the IgG2 hinge sequence CCVECPPCPAPPVA (amino acids 9-22 of SEQ ID NO: 6) as in SEQ ID NOs: 38, 40, 41, 54-55, or overlapping by the N-terminal cysteine of CPPCPAPPVA (amino acids 13-22 of SEQ ID NO: 6) as in SEQ ID NOs: 37, 39, and 46-53.

Neutralization assays were performed using SARS coronavirus S protein pseuodoviruses on MLV vectors encoding Firefly luciferase. Two types of target cells were used to generate virus neutralization data: (1) 293T cells transformed to express human ACE2 (SEQ ID NO: 1) and (2) Vero cells. The data shown here are from 293T cells transformed to express human ACE2 (SEQ ID NO: 1). MLV pseudoviruses are incubated with serial three-fold dilutions of the ACE2 mutein for 1 hour at 37° C., and then trypsinized ACE2-293T cells are added in 96-well format. Luciferase activity is read after 48 hours using the BriteLite-Plus luciferase substrate (PerkinElmer).

As shown in FIG. 5, A25V indeed improved the potency with which ACE2-Ig neutralized SARS-CoV-1 (FIG. 5A), SARS-CoV-2 (FIG. 5B), and a furin(−) mutant SARS-CoV-2 (FIG. 5C) in a neutralization assay.

Against SARS-CoV-2, A25V improved the 80% neutralization titer of ACE2-Ig by 10-fold. L97F improved neutralization of SARS-CoV-1 by 2-fold but did not appear to improve neutralization of SARS-CoV-2. Increases in neutralization potency also were noted for ACE2-Ig proteins bearing A342V (FIG. 5D-F). Thus, the strategy of stabilizing the hydrophobic interior of ACE2 adjacent to RBD contacts (S19-S106 and P336-M360 of SEQ ID NO: 1) was successful in improving affinity for the RBD and SARS coronavirus neutralization. Without the intention of being limited by any particular theory, these results suggest that certain space-filling mutations at buried positions in this region, e.g., A25V, L97F, and A342V, may stabilize the conformation of ACE2 that SARS coronaviruses recognize as their receptor.

Next, neutralization assays were performed using ACE2-Ig variants with and without the collectrin domain. Adding the collectrin domain to ACE2-Ig improves neutralization of SARS coronaviruses (FIG. 5D-F). ACE2-Ig variants comprising a collectrin domain are denoted with a "C" in FIGS. 5D-F. The improvement in neutralization afforded by the collectrin domain is further enhanced by A25V against SARS-CoV-1 (FIG. 5D), SARS-CoV-2 (FIG. 5E), and furin (−) SARS-CoV-2 (FIG. 5F). A variant of ACE2-Ig that combined both the collectrin domain and A25V enhanced neutralization of SARS-CoV-2 by 47-fold (FIG. 5E). Thus, combining stabilizing mutations adjacent to RBD contacts (S19-S106 and P336-M360) with the collectrin domain greatly enhanced neutralization of SARS coronaviruses by ACE2-Ig.

The neutralization enhancement afforded by A25V is indeed due to an increase in the affinity with which ACE2-Ig binds the RBD. An enzyme-linked immunosorbent assay (ELISA) was performed to directly measure binding to the RBD of SARS-CoV-2. The RBD of SARS-CoV-2 was coated onto ELISA plates, and probed with ACE2-Ig variants. In both contexts, with and without the collectrin domain, A25V increased the binding of ACE2-Ig to the SARS-CoV-2 RBD by ELISA (FIG. 5G). Thus, the strategy of stabilizing the conformation of the region of ACE2 adjacent to the RBD with internal substitutions was successful in improving binding to the RBD.

The space-filling substitutions A25V and A342V were combined. ACE2-Ig containing both A25V and A342V was tested for neutralization of furin (−) SARS-CoV-2, and compared against ACE2-Ig variants containing A25V and A342V alone (FIG. 5H). The ACE2-Ig variant with the combination of A25V and A342V indeed improved neutralization potency, decreasing the concentration of ACE2-Ig that is needed to inhibit 80% of pseudovirus infection.

Next, the effects of substitutions on thermal stability were investigated using differential scanning fluorometry (DSF). This assay was conducted using the Protein Thermal Shift assay kit available from ThermoFisher Scientific. Methods for measuring thermal stability by DSF are known in the art (e.g., Niesen et al. (2007) NAT PROTOC 2 (9), 2212-21; Simeonov (2013) EXPERT OPIN DRUG DISCOV. 8(9):1071-82; Malik and Alsenaidy, (2017) BIOTECH. 7(2):100; Delport and Hewer, (2019) PROTEIN J. 38(4):419-424).

Filling empty spaces within the hydrophobic interior of ACE2 indeed improved its thermal stability. The effects of A25V, A25L, and A342V on the thermal stability of ACE2-Ig is shown in FIG. 6A. A25V did not increase the thermal stability of ACE2-Ig (FIG. 6A). However, in ACE2-Ig proteins with and without the collectrin domain, A343V increased the melting temperature ($t_m$) of ACE2-Ig by about 3° C.—which is a substantial improvement (FIG. 6A).

Notably, the presence of the collectrin domain did not affect the overall thermal stability of ACE2-Ig (FIG. 6A). This result suggests that the collectrin domain does not have lower inherent conformational stability than the main body of the ACE2 protein (i.e., SEQ ID NO: 1).

Several additional substitutions were made to fill empty spaces near RBD contacts, e.g., the region between S19-S106 and P336-M360. These included A25L, A36L, A80V, I88F, and L97F. Among these, none measurably improved the thermal stability of ACE2-Ig, at least as measured by DSF (FIG. 6B). Indeed, A36L appeared to decrease the thermal stability of the protein.

The protein engineering strategy described above was used to identify A25V and A342V as substitutions that stabilize a conformation of ACE2 that improves the ability of ACE2-Ig to neutralize SARS coronaviruses. Although neither of these amino acids makes direct contact with a SARS coronavirus RBD, they reside adjacent to direct contacts, within the hydrophobic interior of ACE2. Without the intention of being limited by any particular theory, these substitutions may have improved virus neutralization by stabilizing the conformation that is recognized by the viral RBD. This stabilization resulted in a sizable increase in thermal stability that could be detected by DSF in the case of A342V, and a sizable increase in RBD-binding affinity that could be detected by ELISA in the case of A25V. Thus, the strategy of stabilizing ACE2 by filling empty spaces within the hydrophobic interior of ACE2 was successful.

Example 2—Effects of Catalytic Site Substitutions on the Stability of ACE2-Ig

Mutations that previously have been used to make a catalytically-inactive form of ACE2-Ig are H374N/H378N. However, it is believed that the effect of these mutations on the thermal stability of ACE2 or ACE2-Ig has not previously been determined. As described in more detail below, it was surprising found that H374N/H378N greatly destabilized ACE2-Ig-reducing its melting temperature by 6° C. in DSF assays (FIG. 7A). Indeed, the 47.6° C. melting temperature measured for ACE2-Ig containing the H374N/H378N substitutions is sufficiently low to make developability as a pharmaceutical product unlikely. Therefore, other strategies must be identified to generate a catalytically-inactive form of ACE2 that has adequate thermal stability to be developed as a pharmaceutical product.

It was theorized that mutations that affect substrate binding might provide an alternative approach for inactivating the catalytic activity of ACE in ACE2-Ig without destabilizing the molecule. The effects of the substitutions R273Q, H345A, E375A, H505A, and H505L on the thermal stability of ACE2-Ig (FIG. 7B) was therefore evaluated. All of the ACE2 muteins containing the substrate-binding substitutions R273Q, H345A, H475A, H505A, and H505L had a higher melting temperature than H374N/H378N as measured by DSF. Indeed, H505A appears to have no impact on thermal stability. Thus, an approach for making a catalytically-inactive ACE2-Ig without destabilizing the molecule has been identified, based on substitutions other than H374N and H378N.

An approach for inactivating the catalytic site while introducing a disulfide bond also was evaluated. A non-native pair of cysteine residues was introduced, where one of the non-native cysteines was at a position corresponding to H374 or H378 of human ACE2 (SEQ ID NO: 1). These proteins were expressed and evaluated for thermal stability by DSF (FIG. 7C). Other pairs of non-native cysteine residues evaluated were H374C/G405C and H374C/S409C. Although H374C/S409C may have been slightly destabilizing in comparison to a wild-type ACE2 (SEQ ID NO: 1) sequence with histidines present at positions H374 and H378, it was not as destabilizing as H374N/H378N. However, H374C/G405C increased thermal stability in comparison to the wild-type protein sequence. Although the increase in melting temperature by H374C/G405C was relatively modest (2.3° C.), it is notable that this approach for making an catalytically-inactive ACE2 mutein increased the thermal stability of the protein.

Example 3—Closing the Substrate-Binding Cleft of ACE2 Increases Thermal Stability It was hypothesized that closing the substrate-binding cleft of ACE2 might improve its stability and pharmacokinetics (PK), while also providing an alternate means of rendering the protein catalytically inactive. To close the substrate-binding cleft of ACE2, pairs of non-native cysteine residues were introduced, where the two non-native cysteine residues of each pair are on opposite sides of the angiotensin II substrate-binding cleft of ACE2. Thus, the pair of cysteine residues might form a disulfide across the substrate-binding cleft of ACE2, and that disulfide might constrain ACE2 in a closed or partially-closed conformation.

To identify potential sites for engineering disulfides that might constrain a closed conformation, the structure of ACE2 when it is bound to the inhibitor MLN-4760 (Protein Data Bank structure 1R4L) was examined. Relying partly on this structure, an initial three pairs of disulfides were engineered into ACE2-Ig. The initial three pairs of non-native cysteine residues evaluated were: K74C and S106C, S128C and V343C, and T276C and D367C. The positions mutated in each pair are on opposite sides of the angiotensin II substrate-binding cleft of ACE2. S128C and V343C were initially made in combination with C344S and C361S, in order to prevent the non-native cysteines introduced by the substitutions S128C or V343C from forming unintended disulfides with the nearby native cysteines C344 and C361. TABLE 11 shows the yields obtained by transient transfection to express these variants of ACE2-Ig in the presence and absence of the ACE2 inhibitor MLN-4760. The yields of proteins produced in the presence and absence of MLN-4760 were measured, because it was expected that MLN-4760 might be necessary to hold ACE2 in a conformation that allows the disulfides to form. It was expected that the disulfides would form and the proteins would be expressed only when the proteins were produced in the presence of the ACE2 inhibitor MLN-4760. Surprisingly, however, ACE2-Ig proteins with two out of three of the disulfides introduced were expressed in the absence of the ACE2 inhibitor MLN-4760 (TABLE 11). ACE2-Ig proteins containing K74C and S106C and S128C and V343C were expressed, suggesting the disulfide bonds formed as intended, even in the absence of the inhibitor. In addition, the ACE2-Ig protein containing both pairs of non-native cysteines K74C and S106C and S128C and V343C also was expressed both in the presence and absence of the inhibitor (TABLE 11). Only T276C and D367C prevented expression of ACE2-Ig, and the expression of ACE2-Ig variants containing T276C and D367C was not rescued by the presence of the ACE2 inhibitor MLN-4760. The combinations of pairs of non-native disulfides including T276C/D367C also did not express, regardless of the presence or absence of the inhibitor. Thus, two pairs of non-native cysteines were identified that appear to be capable of forming disulfides across the substrate-binding cleft of ACE2, even in the absence of the ACE2 inhibitor MLN-4760.

TABLE 11

| ACE-Ig Mutein | [MLN-4760] | Yield (mg/L) |
| --- | --- | --- |
| Wild-type ACE2 (amino acids 19-615 of SEQ ID NO: 1) | None | 6.2 |
| Wiki-type ACE2 (amino acids 19-615 of SEQ ID NO: 1) | 440 nM | 23.5 |
| K74C/S106C | None | 26.8 |
| K74C/S106C | 440 nM | 18.0 |
| S128C/V343C/C344S/C361S | None | 30.1 |
| S128C/V343C/C344S/C361S | 440 nM | 17.0 |
| T276C/D367C | None | 0.5 |
| T276C/D367C | 440 nM | 0.2 |
| K74C/S106C/S128C/V343C/C344S/C361S | None | 28.3 |
| K74CZS106C/S128C/V343C/C344S/C361S | 440 nM | 28.2 |
| K74C/S106C/T276C/D367C | None | 0.2 |
| K74C/S106C/T276C/D367C | 440 nM | 0.3 |
| S128C/V343C/C344S/C361S/T276C/D367C | None | 0.5 |
| S128C/V343C/C344S/C361S/T276C/D367C | 440 nM | 0.3 |
| K74C/S106C/S128C/V343C/C344S/C361S/T276C/D367C | None | 0.7 |
| K74C/S106C/S128C/V343C/C344S/C361S/T276C/D3670 | 440 nM | 0.3 |

The homogeneity of ACE2-Ig proteins containing non-native cysteines on opposite sides of the angiotensin II-binding cleft was assessed by native protein gel electrophoresis. The proteins that did not express due to containing T276C/D367C were omitted from the gel. The most homogeneous protein was the ACE2-Ig with the wild-type ACE2 sequence, with minor bands at higher molecular weights being visible for the ACE2 muteins containing non-native cysteines on opposite sides of the angiotensin II-binding cleft (FIG. 8). Two observations were particularly notable: first, the introduction of non-native cysteines at positions K74C/S106C and S128C/V343C was not catastrophic. The majority of the protein was expressed as a homodimer of the expected molecular weight. Although unwanted higher molecular weight oligomers were observed, these were a minor component of the total protein, suggesting that combining the non-native cysteines with other stabilizing mutations might greatly reduce the production of unwanted higher molecular weight oligomers. For instance, these non-native cysteines, which are expected to form disulfides, could be combined with space-filling mutations that increase the thermal stability of ACE2, such as A342V. A second notable observation was that the presence of MLN-4760 appeared to reduce the amount of unwanted higher molecular weight oligomers formed when expressing the ACE2-Ig variant containing both K74C/S106C and S128C/V343C. Therefore, MLN-4760 may have worked as intended: stabilizing the closed conformation of the angiotensin II-binding cleft of ACE2, promoting the formation of disulfides at K74C/S106C and S128C/V343C. Surprisingly, MLN-4760 was not necessary for the proteins containing pairs of non-native cysteines on opposite sides of the angiotensin II substrate-binding cleft to be expressed. This experiment demonstrates the surprising result that ACE2-Ig muteins containing non-native cysteines, where one of the cysteines is disposed on one side of the angiotensin II-binding cleft, and the other cysteine is disposed on the opposite side of the cleft, are expressed and form the desired immunoadhesin homodimer with few unwanted higher molecular weight forms, and furthermore, that the presence of an ACE2 inhibitor, e.g., MLN-4760, can improve the fidelity of disulfide bond formation across the angiotensin II-binding cleft.

Figure 9:
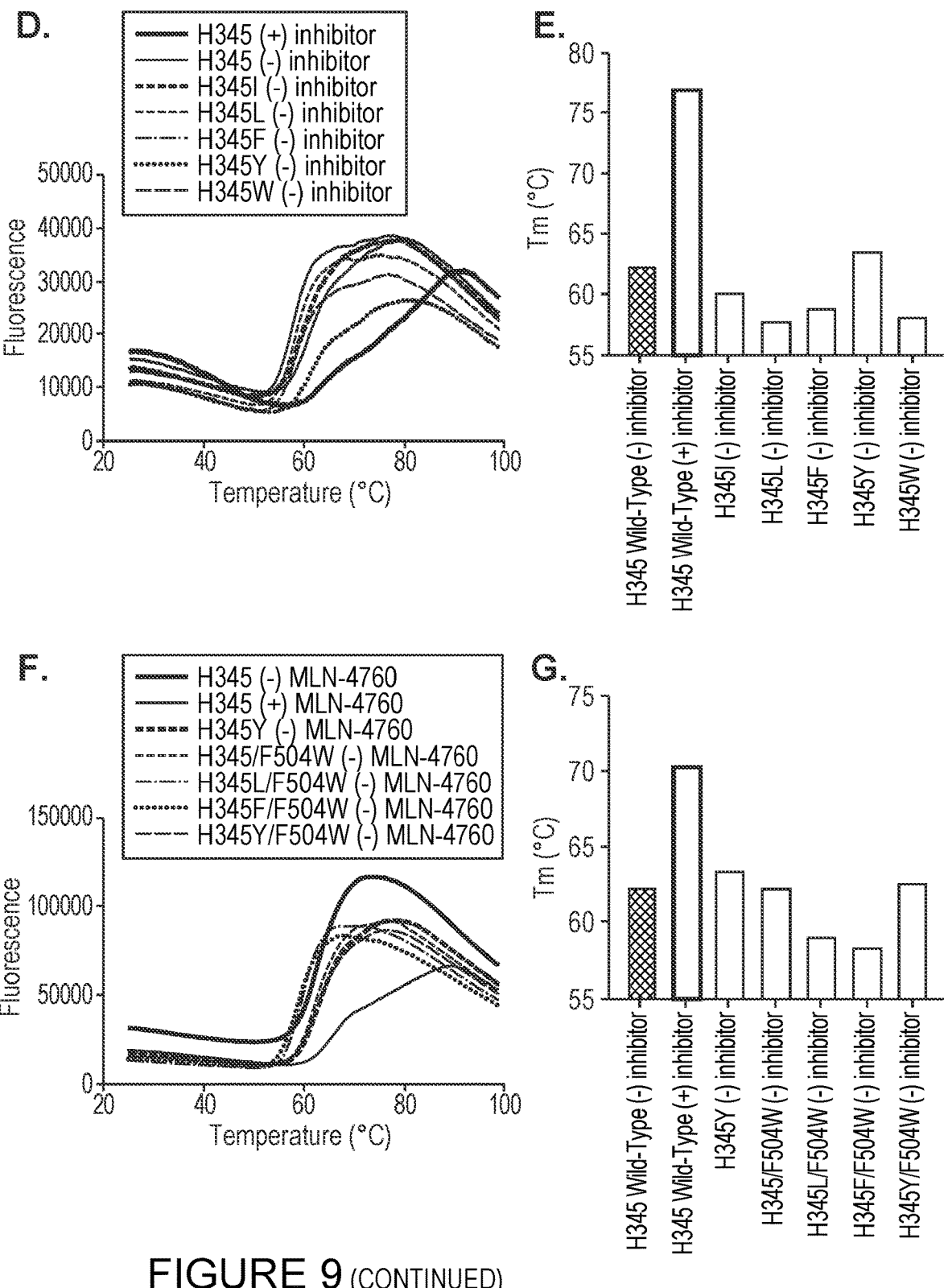
FIGS. 9A-G is a series of graphs showing the melting temperatures of ACE2-Ig proteins containing pairs of non-native cysteine residues on opposite sides of the angiotensin II substrate-binding cleft of ACE2.

Next, the thermal stability of ACE2-Ig variants with and without non-native cysteines on opposite sides of the angiotensin II-binding cleft was tested. K74C/S106C dramatically improved the thermal stability of ACE2-Ig, increasing its melting temperature by 6.8° C., from 53.9° C. to 60.7° C., as measured by DSF (FIG. 9A). S128C/V343C/C344S/ C361S did not appear to substantially affect the thermal stability of ACE2-Ig, and may have slightly decreased it, at least when combined with K74C/S106C (FIG. 9A). Intriguingly, producing ACE2-Ig proteins in the presence of an ACE2 inhibitor, MLN-4760, generally increased their thermal stability (FIG. 9B). Surprisingly, even the wild-type ACE2-Ig control exhibited an increase in thermal stability when produced in the presence of the ACE2 inhibitor, MLN-4760. Thus, even without engineering disulfides across the substrate-binding cleft of ACE2, contacting ACE2 with an ACE2 inhibitor resulted in a more thermally-stable protein. Without the intention of being limited by any particular theory, the observation of improved thermal stability even in the absence of non-native disulfides may be explained by the inhibitor remaining complexed with ACE2, even after purification, buffer exchange, and storage 4° C., thereby retaining ACE2 in a closed conformation. Importantly, and consistent with the observation that K74C/S106C alone increases thermal stability, this experiment suggests that closed or partially-closed conformations of ACE2 are more stable than the open conformation of ACE2.

This important result suggests it may be desirable to stabilize ACE2 in its closed conformation. Stabilization of ACE2 in its closed conformation can be achieved by contacting the ACE2 protein with an ACE2 inhibitor such as MLN-4760, and through mutations that stabilize the closed conformation, such as the introduction of non-native cysteines on opposite sides of the angiotensin II substrate-binding cleft.

Another important observation from this experiment was that producing ACE2 muteins engineered to have disulfides across the substrate-binding cleft in the presence of an ACE2 inhibitor greatly increased their thermal stability. Whereas the ACE2-Ig mutein containing S128C/V343C/C344S/ C361S had a melting temperature measured by DSF of 58.0° C., producing this ACE2-Ig variant in the presence of MLN-4760 increased its melting temperature by 5.7° C. to 63.7° C. (FIG. 9B). This represents a nearly 10° C. improvement over the wild-type ACE2-Ig protein produced in the absence of the ACE2 inhibitor. These data suggest that stabilization of a conformation of ACE2 in which substrate accessibility to the angiotensin II substrate-binding cleft is reduced (e.g., closed, for example, with an ACE2 inhibitor), combined with engineering disulfides across the substrate-binding cleft of ACE2 by introducing pairs of non-native cysteines on opposite sides of the angiotensin II substrate-binding cleft, can improve the stability of ACE2 muteins.

Moreover, these are two independent and combinable approaches for improving the stability of ACE2 muteins. In the first approach suggested by the results described above, an ACE2 mutein is contacted with an ACE2 inhibitor (e.g., MLN-4760) to stabilize it in the closed conformation. In the second approach, the closed conformation is stabilized with mutations (e.g., pairs of non-native cysteines on opposite sides of the angiotensin II substrate-binding cleft that form disulfides). In these experiments, combining these approaches provided the greatest improvement in stability (i.e., greatest thermal stability in DSF assays).

Next, a collectrin domain was introduced into the ACE2-Ig variant containing K74C/S106C, and the thermal stability of this variant was measured in the presence and absence of the ACE2 inhibitor MLN-4760. Previously, in the absence of the collectrin domain, the presence of the inhibitor MLN-4760 did not markedly change the melting temperature of ACE2-Ig variants containing K74C/S106C (FIG. 9B). However, in the presence of the collectrin domain, the presence of the inhibitor MLN-4760 increased the melting temperature of the ACE2-Ig protein containing K74C/S106C by 8.9° C., from 61.1° C. to 70.0° C. (FIG. 9C). This nearly 9° C. increase was surprising, because the inhibitor MLN-4760 only improved the thermal stability of the wild-type protein by 5.7° C. Thus, the disulfide formed by K74C/S106C and/or the collectrin domain appeared to act cooperatively with the inhibitor to increase thermal stability.

Amino acid substitutions hypothesized to stabilize the closed conformation of the substrate-binding cleft of ACE2 were evaluated in ACE2-Ig proteins containing K74C/ S106C and a collectrin domain. In an ACE2-Ig protein containing K74C/S106C/A342V and a collectrin domain, the thermal stability of variants comprising H345I, H345L, H345F, H345Y, and H345W were evaluated by DSF (FIG. 9D-E). The raw data are presented in FIG. 9D and the melting temperatures are presented in FIG. 9E. These H345-substituted variants were produced in the absence of the ACE2 inhibitor MLN-4760. As controls, the ACE2-Ig protein containing K74C/S106C/A342V and a collectrin domain were produced in the presence and absence of the ACE2 inhibitor MLN-4760. The inclusion of A342V in this variant appeared to further increase the melting temperature of the ACE2-Ig protein containing K74C/S106C plus the collectrin domain, with its melting temperature now reaching 77.0° C. in the presence of the ACE2 inhibitor MLN-4760. One substitution, H345Y, appeared to partially restore the thermal stability conferred by the ACE2 inhibitor MLN-4760, with the raw data collected in the DSF assay qualitatively resembling that produced for the control protein made in the presence of the inhibitor (FIG. 9D), and an increase in melting temperature of 1.2° C. from 62.3° C. to 63.5° C. (FIG. 9E). Thus, substitutions at H345 (e.g., H345Y) may help to mimic the presence of the ACE2 inhibitor MLN-4760, and thereby improve thermal stability, particularly in the context of K74C/S106C and a collectrin domain.

Substitutions at F504, e.g., F504W, were hypothesized to promote the closure of the substrate-binding cleft of ACE2. Therefore, ACE2-Ig variants comprising K74C/S106C, A342V, the collectrin domain, and the substitution F504W were generated. These muteins were made with or without substitutions at position H345, e.g., H345L, H345L, H345F, H345Y, and H345W. Control proteins that had the wild-type amino acids present at H345 and F504, but included K74C/S106C, A342V, and a collectrin domain, were produced in the presence and absence of the ACE2 inhibitor MLN-4760. The thermal stability of these ACE2-Ig proteins was assessed by DSF (FIG. 9F). Other than the control protein made in the presence of MLN-4760, which had a melting temperature of 70.4° C., the most thermostable proteins were those comprising H345Y. The ACE2-Ig variant comprising the collectrin domain, K74C/S106C, A342V, and H345Y had a melting temperature of 63.5° C., consistent with the previous result, and the variant with those substitutions plus F504W had a melting temperature of 62.8° C., which is a modest decrease. Notably, all of these variants decreased the background fluorescence detected at the range of temperatures from approximately 25° C. to 50° C. relative to the control protein that had the wild-type amino acids at positions H345 and F504. Without the intention of being limited to any particular theory, the reduced background fluorescence may indicate that these substitutions reduce the structural fluidity of the protein at physiologic temperatures. In summary, these experiments suggest that substitutions at positions H345 and F504, may promote the closure of the substrate-binding cleft and/or may improve the stability of ACE2 muteins, particularly H345Y, which consistently showed the greatest improvement in thermal stability as measured by DSF.

Figure 10A:
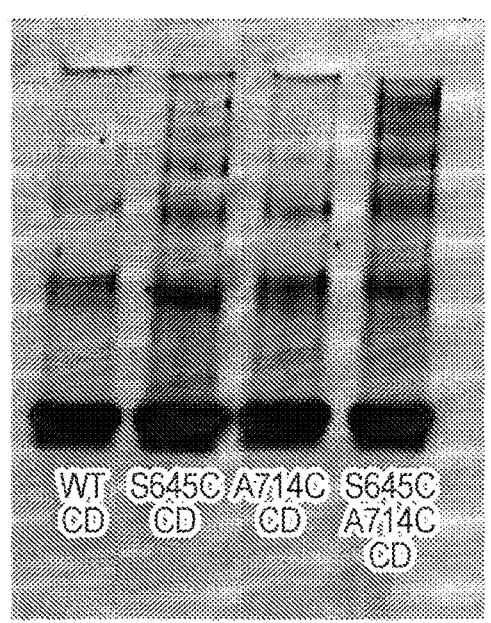
FIGS. 10A-C provide a photograph (FIG. 10A) and size exclusion chromatograms (FIGS. 10B-C) relating to muteins with non-native disulfide mutations.

Example 4—Stabilization of the Collectrin Domain Homodimerization Interface with a Disulfide Mutations were engineered into the collectrin domain of an ACE2-Ig protein to stabilize its homodimerization interface. These mutations included S645C and A714C. ACE2-Ig variants containing S645C and A714C alone and in combination were expressed. The presence of oligomers other than dimers was assessed by native gel electrophoresis (FIG. 10A). The A714C substitution resulted in a much more modest increase in unwanted oligomers than S645C or the combination of S645C and A714C. Because the combination of both S645C and A714C resulted in substantially more oligomers other than dimers than S645C alone, having a single, i.e., exactly one, non-native disulfide within the collectrin domain may be beneficial. Therefore, a A714C substitution provides a means of bridging the collectrin domains of the ACE2-Ig homodimer with a disulfide. Thus, it is possible to obtain ACE2-Ig proteins comprising non-native cysteines, and to bridge the collectrin domains across an ACE2-Ig homodimer with a disulfide.

Figures 10B, 10C:
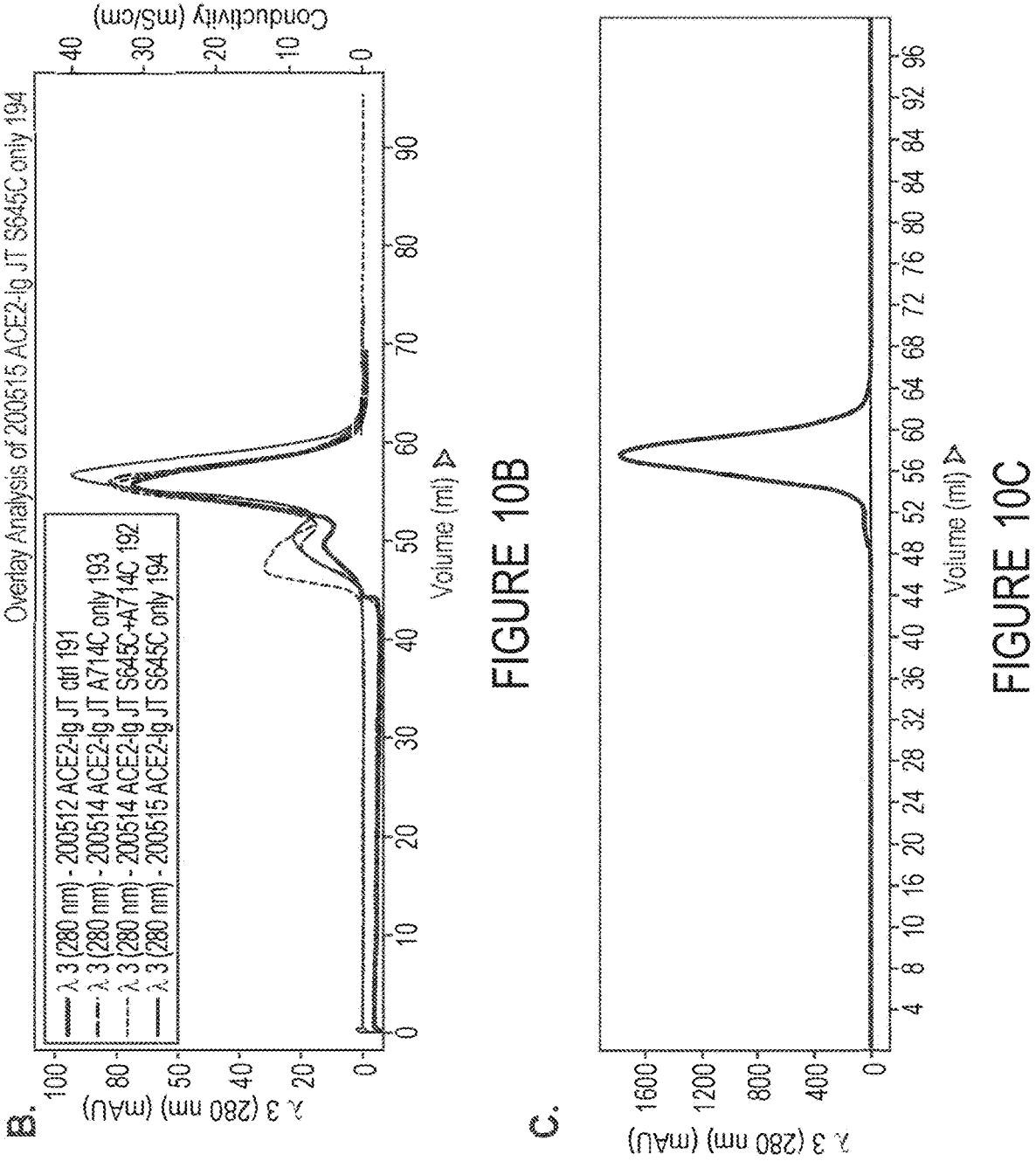

ACE2-Ig variants with and without non-native cysteines engineered to form disulfides across the homodimer interface of the collectrin domain were characterized by size-exclusion chromatography (SEC). A presumptive tetramer product was visible for all of the variants containing the collectrin domain, although the highest molecular weight product was only clear with the combination of S645C and A714C (FIG. 10B). Both wild-type collectrin domain and the collectrin domain containing A714C had a presumptive tetramer peak lacking evidence of higher molecular weight oligomers. The absence of the highest molecular weight fractions in the variants with less than two non-native cysteines in the collectrin domain suggests that ACE2-Ig variants with exactly one non-native cysteine at the dimer interface of the collectrin domain are beneficial for the expression of a homogeneous dimer.

The SEC chromatograms for ACE2-Ig variants containing a collectrin domain contrasted with those for ACE2-Ig variants without a collectrin domain. Whereas the presence of the collectrin domain resulted in high molecular weight oligomers (FIG. 10B), ACE2-Ig without the collectrin domain expressed as 98% homodimer (FIG. 10C). These SEC chromatograms show that collectrin domains, with or without non-native disulfides, cause the formation of a substantial amount of high molecular weight oligomer as an undesirable impurity in ACE2-Ig protein production.

Figure 11:
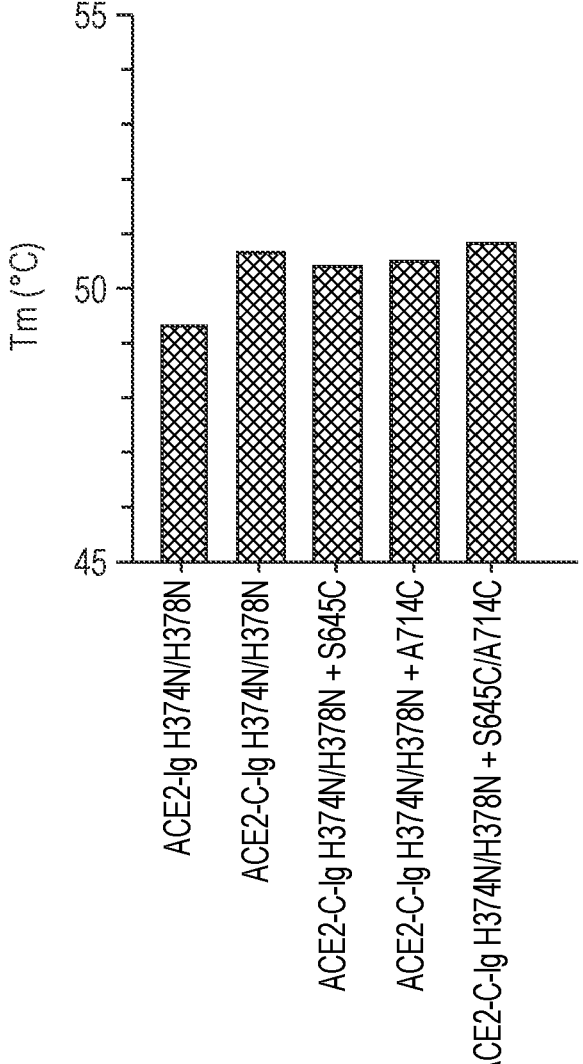
FIG. 11 is a bar graph showing the melting temperatures of ACE2-Ig proteins with and without a collectrin domain measured by DSF. The variants marked "ACE2-Ig" lack a collectrin domain, whereas the variants marked "ACE2-C-Ig" contain a collectrin domain. The ACE2-C-Ig variants tested included a wild-type collectrin domain (amino acids 616-739 of wild-type human ACE2 (SEQ ID NO: 1)), and variants with the substitution S645C, A714C, and both S645C and A714C. These may form C645-C645 and C714-C714 disulfides across the homodimerization interface of the collectrin domain.

The thermal stability of the ACE2-Ig muteins containing the collectrin domain was assessed. Surprisingly, the ACE2-Ig variants that included the collectrin domain had higher thermal stability than those without the collectrin domain (FIG. 11). This result is unexpected, because the collectrin domain is generally not resolved in x-ray crystal structures of ACE2, suggesting that it has low conformational stability. Potential stabilizing mutations were introduced into ACE2 at positions S645 and A714 in SEQ ID NO: 1, including S645C and A714C. The introduction of non-native cysteines through the mutations S645C and/or A714C at least did not destabilize the molecule (FIG. 11). Thus, the above results provide the surprising finding that the collectrin domain may modestly stabilize ACE2-Ig, and that positions S645 and A714 can be substituted without destabilizing the molecule.

Figure 12:
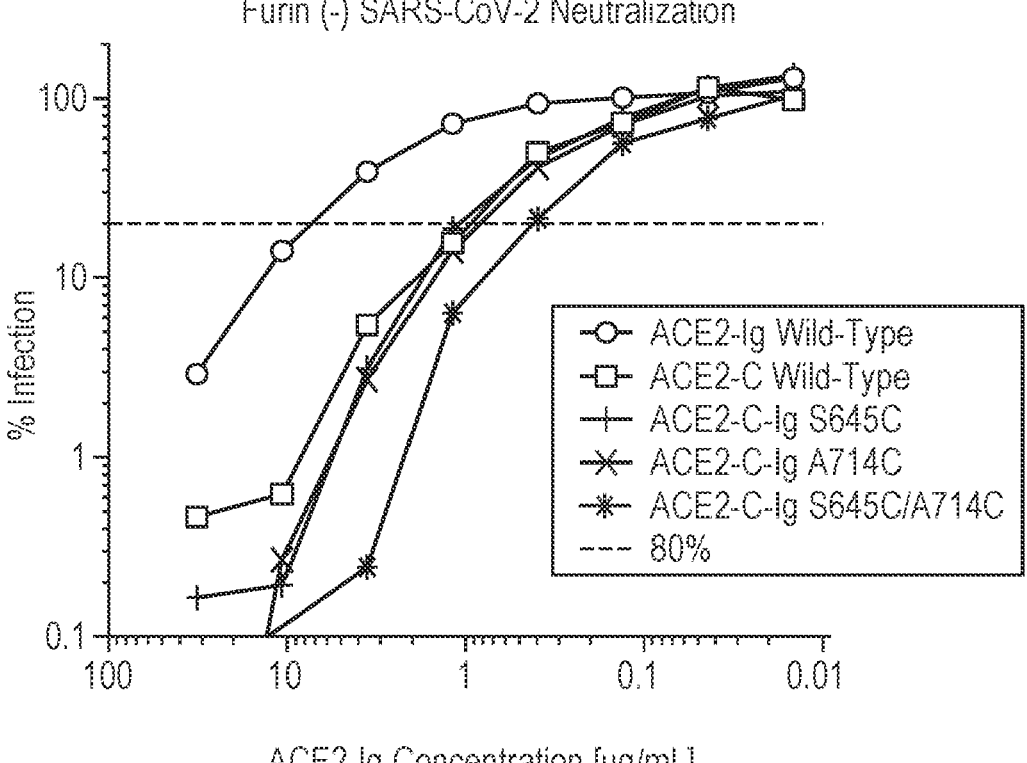
FIG. 12 provides a line graph showing the results of SARS coronavirus neutralization assays by ACE2-Ig variants with or without a collectrin domain. The reporter virus used here was a furin cleavage site-negative SARS-CoV-2 spike S protein MLV pseudovirus expressing firefly luciferase. The variants marked "ACE2-Ig" lack a collectrin domain, whereas the variants marked "ACE2-C-Ig" contain a collectrin domain. The ACE2-C-Ig variants tested included a wild-type collectrin domain (amino acids 616-739 of wild-type human ACE2 (SEQ ID NO: 1)), and variants with the substitution S645C, A714C, and both S645C and A714C.

Yet another surprising result was that stabilizing the collectrin domain enhanced SARS coronavirus neutralization. SARS-CoV-2 pseudovirus neutralization by variants of ACE2-Ig with and without a collectrin domain stabilized by engineering disulfides through the introduction of non-native cysteines at positions S645 and A714 (FIG. 12) were compared. Surprisingly, the ACE2-Ig variants containing the non-native cysteines S645C and A714C alone and in combination neutralized virus infectivity more effectively than an otherwise-identical ACE2-Ig variant with an unmodified collectrin domain based on the sequence of wild-type human ACE2 (SEQ ID NO: 1). Without the intention of being limited by any particular theory, one interpretation of the enhanced neutralization by the variant with the disulfide-stabilized collectrin domain is that the absence of stabilization results in some loss of the benefit of including the collectrin domain. Thus, it is believed that stabilizing the collectrin domain, specifically including stabilizing the homodimerization interface of the collectrin domain, resulted in enhanced virus neutralization.

Example 5—Non-Native Signal Peptides

Figure 13:
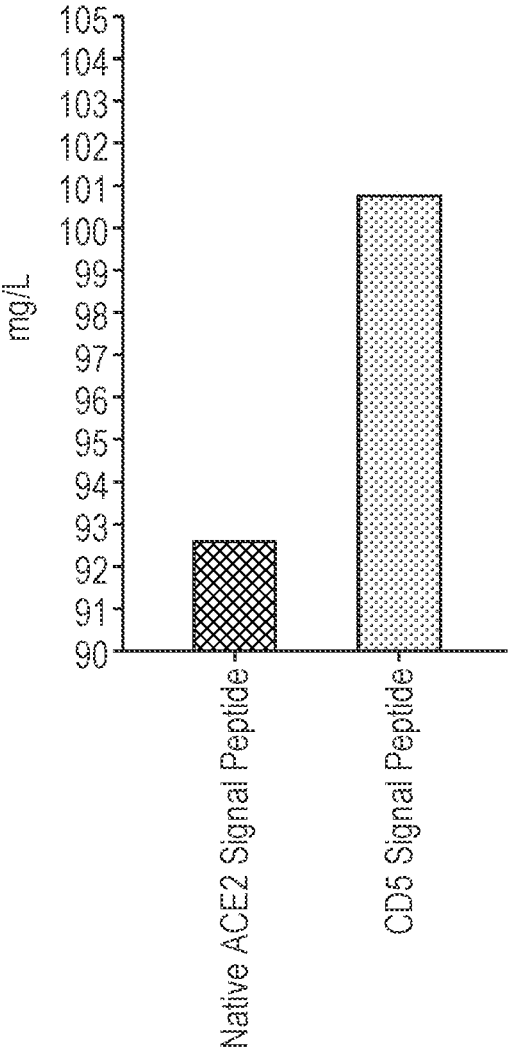
FIG. 13 provides a bar graph of protein expression yields with and without a non-native signal peptide. The non-native signal peptide evaluated here was that of CD5. Otherwise-identical variants of ACE2-Ig were cloned with and without a CD5 signal peptide, and expressed in CHO cells by transient transfection. These ACE2-Ig proteins possessed either a native human ACE2 signal peptide (amino acids 1-18 of SEQ ID NO: 1), or the signal peptide of CD5 (amino acids 1-24 of SEQ ID NO: 29), a wild-type human ACE2 sequence, an IgA1 hinge, and an IgG2 Fc as in SEQ ID NO: 29. The protein yields of these two ACE2-Ig proteins are shown.

A non-native signal peptide was found to improve the expression of an ACE2-Ig protein. It was observed that variants containing a non-native signal peptide improved expression of ACE2-Ig proteins. Therefore, as a controlled experiment, a CD5 signal peptide was cloned onto an ACE2-Ig variant that contained an IgA1 hinge and an IgG2 Fc. The CD5 signal peptide indeed increased the expression of the ACE2-Ig molecule (FIG. 13).

Example 6—Improvements to Protein Production

Figure 14:
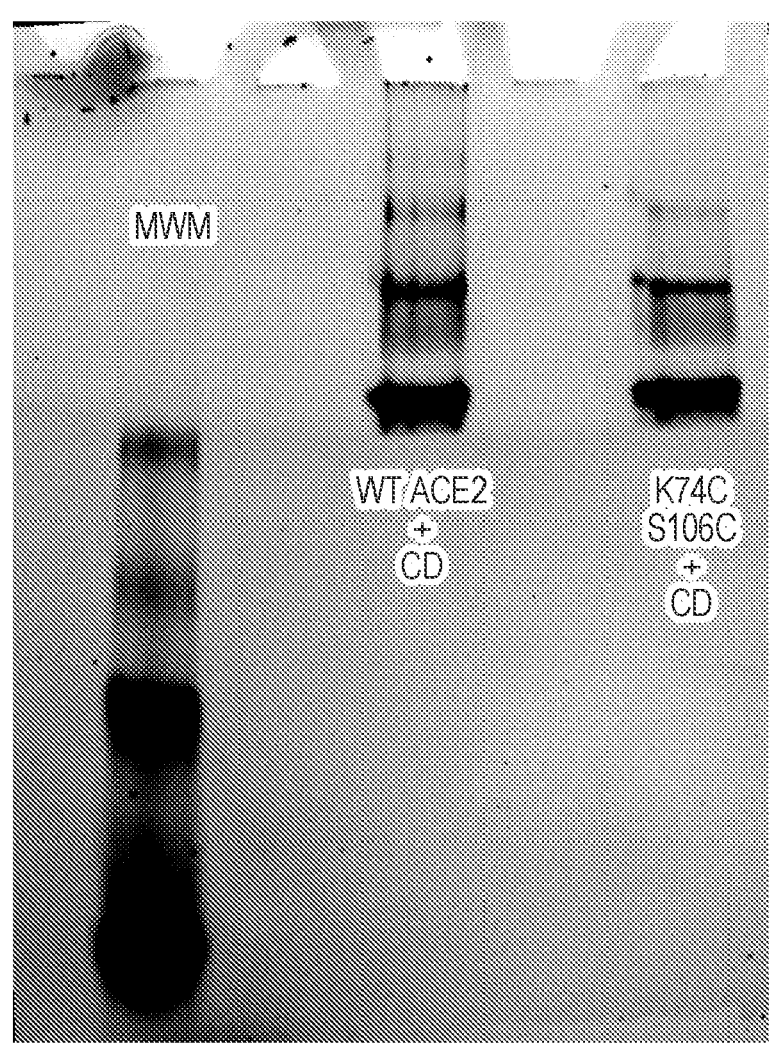
FIG. 14 is a photograph of a native protein gel loaded ACE2-Ig proteins containing the collectrin domain (CD), with and without the substitutions K74C/S106C. A molecular weight marker (MWM) is loaded in the first lane from the left. The center lane contains an ACE2-Ig protein, which contains a wild-type (WT) human ACE2 (SEQ ID NO: 1) sequence through amino acid 740 (i.e., including the collectrin domain). The right lane contains an otherwise-identical ACE2-Ig protein, containing the substitutions K74C/S106C.

It was observed that partially closing or closing the substrate binding cleft by introducing non-native cysteine amino acids disposed on opposite sides of the angiotensin II substrate binding cleft improves the homogeneity of an ACE2-Ig protein, which contained the collectrin domain. Two otherwise-identical ACE2-Ig proteins containing the collectrin domain (i.e., containing amino acids 19-740 of SEQ ID NO: 1), with and without the pair of non-native cysteine amino acid substitutions K74C and S106C were run on a native protein gel (FIG. 14). The ACE2-Ig variant containing the K74C/S106C substitutions was observed to be more homogeneous, having fewer undesirable high molecular weight aggregates, than the otherwise-identical protein based on wild-type sequences. Thus, closing the substrate-binding cleft of ACE2-Ig with a non-native pair of cysteines disposed on opposite sides of the angiotensin-binding cleft is a strategy for improving protein homogeneity and decreasing the presence of unwanted aggregates.

Example 7—Substitutions that Increase SARS Coronavirus Neutralization Potency in Combination Combinations of substitutions were evaluated in the region of ACE2 that makes contact with the RBD. These included A25V/Q24E, A25V/T27K, A25V/D30E, A25V/H34S A25V/N90D, and A25V/A342V. TABLE 12 shows the production efficiency yields of these proteins. Although modest decreases in the production yields were noted, it was concluded that these substitutions were compatible with each other, at least in terms of not inhibiting protein production.

TABLE 12

| ACE2-Ig Mutein | Yield (mg/L) |
| --- | --- |
| Wild-type ACE2 (amino acids 19-615 of SEQ ID NO: 1) | 156.8 |
| A25V | 147.2 |
| A25V/A342V | 130.8 |
| A25V/N90D | 103.6 |
| A25V/Q24E | 121.2 |
| A25V/T27K | 110.4 |
| A25V/D30E | 106.4 |
| A25V/H34S | 102.0 |

The thermal stability of ACE2-Ig proteins containing the combinations of substitutions in TABLE 12 was assessed by DSF. Combining A25V with A342V resulted in an increase in the melting temperature of ACE2-Ig from 52.6° C. to 55.8° C., which was the largest increase in thermal stability among these particular combinations (FIG. 15A). The next-largest increase in thermal stability was conferred by combining A25V with N90D, an improvement from 52.6° C. to 54.1° C. Importantly, combining A25V with Q24E, T27K, D30E, H34S, N90D, or A342V did not decrease thermal stability. Thus, A25V can be combined with any of these mutations without negatively affecting the thermal stability of the ACE2 mutein.

Neutralization of SARS-CoV-2 pseudoviruses by ACE2-Ig variants bearing the combinations of substitutions A25V/Q24E, A25V/T27K, A25V/D30E, A25V/H34S A25V/N90D, and A25V/A342V was evaluated. Q24E appeared to be poorly compatible with A25V, reducing virus neutralization in comparison to an A25V-only variant of ACE2-Ig (FIG. 16A). By contrast, combining A25V with N90D dramatically increased virus neutralization. T27K, D30E, H34S, and A342V did not appear to substantially affect virus neutralization when combined with A25V in this context.

ACE2-Ig muteins containing combinations of these and additional substitutions were evaluated. These experiments were designed to determine which substitutions were compatible in combination with a collectrin domain and A25V, N90D, and A342V in an ACE2-Ig protein. Yields in mg/L of ACE2-Ig proteins comprising the indicated combinations of potential potency-enhancing mutations are shown in TABLE 13. In addition, for ACE2-Ig proteins that included A25V, N90D, and A342V, the substitutions I259S and C261S were also present. I259S and C261S are not listed in TABLE 13 for space and clarity. Listed individually, the substitutions that were tested in combination with a collectrin domain and A25V/N90D/I259S/C261S/A342V were: K27T, L29F, H34S, N49E, N90D, L351F, and A386L. ACE2-Ig proteins comprising an L351F substitution exhibited substantially decreased protein expression yields (TABLE 13). However, ACE2-Ig proteins comprising an L27K, H34S, and/or N49E substitution did not exhibit reduced protein expression yields, and ACE2-Ig proteins comprising an L29F and/or an A386L substitution exhibited only modestly reduced protein expression yields.

TABLE 13

| ACE2-Ig Mutein | Yield (mg/L) |
| --- | --- |
| Wild-type ACE2-Ig (amino acids 19-615 of SEQ ID NO: 1) | 25.7 |
| Wild-type ACE2-C-Ig (amino acids 19-740 of SEQ ID NO: 1) | 12.8 |
| ACE2-C-IgA25V/N90D/A342V | 10.7 |
| ACE2-C-Ig A25V/T27K/H34S/N49E/N90D/A342V | 11.9 |
| ACE2-C-IgA25V/L29F/N90D/A342V | 5.9 |
| ACE2-C-Ig A25V/N90D/A342V/A386L | 6.7 |
| ACE2-C-IgA25V/L29F/N90D/A342V/A386L | 5.1 |
| ACE2-C-Ig A25V/L29F/N90D/A342V/L351F/A386L | 1.2 |
| ACE2-C-Is A25V/T27K/L29F/H34S/N49E/ N90D/A342V/L351F/A386L | 0.69 |

The impact of these combinations of substitutions on thermal stability was assessed by DSF. ACE2-Ig proteins comprising the combination of mutations A25V/N90D/I259S/C261S/A342V improved the melting temperature measured by DSF by 6.3° C. (FIG. 15B). In addition, the melting temperatures were measured for the ACE2-Ig proteins comprising the collectrin domain and A25V/L29F/N90D/I259S/C261S/A342V, A25V/N90D/I259S/C261S/A342V/A386L, A25V/L29F/N90D/I259S/C261S/A342V/A386L, and A25V/T27K/H34S/N49E/N90D/I259S/C261S/A342V. The presence of T27K/H34S/N49E in an ACE2-Ig protein containing the collectrin domain and A25V/L29F/N90D/I259S/C261S/A342V at least did not decrease the thermal stability of the protein. The relative thermal stability of each variant reflected its yield, with modest decreases noted for L29F and A386L alone and in combination.

Neutralization of SARS-CoV-2 pseudoviruses was evaluated to determine which substitutions improved neutralization when present in combination with a collectrin domain and A25V/N90D/A342V. Combinations that included (1) T27K/H34S/N49E, or (2) L29F and A386L alone and in combination, improved virus neutralization (FIG. 16B). These neutralization assays were repeated, the second time including the combinations A25V/L29F/N90D/A342V/L351F/A386L and A25V/T27K/L29F/N90D/A342V/L351F/A386L, which include the substitution L351F that was not included in the first assay (FIG. 16C). The variants comprising L351F exhibited reduced virus neutralization potency in comparison to the otherwise-identical proteins (A25V/L29F/N90D/A342V/A386L and A25V/T27K/L29F/N90D/A342V/A386L) lacking the L351F substitution. Thus, T27K/H34S/N49E, L29F, A386L, and L29F/A386L were compatible with A25V/N90D/A342V to further enhance virus neutralization, whereas L351F was not compatible with these combinations of substitutions.

Example 8—Amino Acid Substitutions that Stabilize the Collectrin Domain

Two complementary approaches were taken to stabilize the collectrin domain. It had been observed that ACE2-Ig variants lacking the collectrin domain produced relatively small amounts of undesirable high molecular weight oligomers (FIG. 10C). This contrasted with collectrin domain-containing ACE2-Ig variants, which produce undesirable high molecular weight oligomers (FIG. 10B). Without wishing to be bound by any particular theory, it was hypothesized that an improperly-folded collectrin domain may be responsible for the formation of high molecular weight oligomers. For instance, and again without wishing to be bound by any particular theory, an unfolded collectrin domain may non-specifically interact with other proteins, forming protein aggregates, or may cause a properly-folded collectrin domain of an ACE2-Ig homodimer to dimerize with an ACE2-Ig monomer other than the one with which its Fc is dimerized. Therefore, the strategy of identifying space-filling substitutions within the collectrin domain was undertaken as an approach for stabilizing the hydrophobic core of the collectrin domain. While this strategy is intended to promote the proper folding of the protein by stabilizing its hydrophobic core, a complementary approach is the replacement of the solvent-exposed hydrophobic amino acids on the surface of the collectrin domain. Thus, two complementary approaches for promoting the proper folding and stability of the collectrin domain were pursued: introducing space-filling mutations within its hydrophobic core, and replacing solvent-exposed hydrophobic amino acids with hydrophilic amino acids.

Sites for space-filling mutations in the collectrin domain were prioritized in accordance with TABLE 4, TABLE 8, and TABLE 9, plus a qualitative analysis of the structure 6M17. Sites prioritized for the strategy of replacing a buried amino acid or a partially-buried serine in wild-type human ACE2 (SEQ ID NO: 1) by a threonine, hydrophobic amino acid, or aromatic amino acid having more carbon atoms or a greater molecular weight than the amino acid that is replaced included: V620, I622, S645, S646, V647, A650, V670, V672, L675, I679, V685, V700, I704, S707, I711, A714, S721, and F724. The specific substitutions prioritized for evaluation were: V620I, V620L, I622L, S645T, S645V, S645I, S646T, S646V, S646I, V647I, V647L, A650V, A650I, V670I, V670L, V672I, V672L, L675F, I679L, V685I, V685L, V700I, V700L, I704L, S707T, I711 L, A714V, A714I, S721T, and F724W. Several of these substitutions are represented in non-human primates or other mammals. For instance, S646I is common in mammals, V647I exists in Ma's night monkey, V672I exists in the tarsier, L675F exists in the golden snub-nose monkey and gray mouse lemur, A714V exists in the gray mouse lemur and Coquerel's sifaka, A714I exists in rats, and S721T exists in little brown bats. ACE2-Ig variants were generated containing these space-filling substitutions and combinations thereof.

Figure 17:
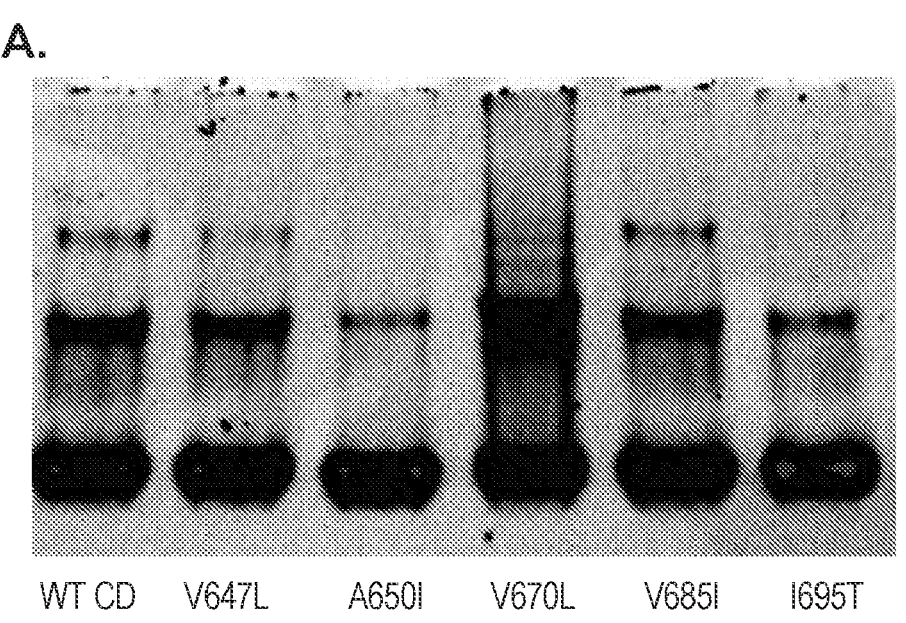
FIGS. 17A-E provide several protein electrophoresis gels with ACE2-Ig proteins with substitutions in the collectrin domain.

Several individual space-filling substitutions were introduced into the collectrin domain of an ACE2-Ig protein containing wild-type human ACE2 sequences and an IgG1 Fc. The first space-filling substitutions tested were: V647L, A650I, V670L, and V685I. ACE2-Ig variants containing these space-filling substitutions in the collectrin domain were expressed and separated by native gel electrophoresis (FIG. 17A). Whereas the protein with the wild-type collectrin domain generated a substantial amount of high molecular weight oligomers, A650I clearly reduced the amount of high molecular weight oligomers that were detectable. In particular, the highest molecular weight oligomer band visible with a wild-type collectrin domain was not discernable when the substitution A650I was present. Inclusion of an V647L substitution also reduced the production of high molecular weight oligomers. By contrast, the substitution V670L caused an increase in high molecular weight oligomers. Thus, space-filling substitutions in the collectrin domain (e.g., A650I) can reduce the formation of unwanted high molecular weight oligomers.

Also, a partially-exposed hydrophobic residue in the collectrin domain, I695, was substituted with a threonine (i.e., to make I695T). Inclusion of I695T in an ACE2-Ig protein resulted in a clear reduction in the formation of unwanted high molecular weight oligomers (FIG. 17A). This observation suggested that substituting exposed or partially-exposed hydrophobic residues in the collectrin domain also may improve the folding of the collectrin domain, and reduce unwanted high molecular weight oligomers.

Additional space-filling substitutions in the collectrin domain and combinations thereof were evaluated in the context of ACE2-Ig proteins, which contained K74C/S106C, A342V, A714C, and an IgG2 Fc domain. In this ACE2-Ig sequence background, the following substitutions and combinations of substitutions were introduced: V647I/V700L, V657I/V670L, V647L, I622L, I622L/I679L/V647I, and I622L/I679L/V647I/V670I. These proteins were produced and separated by native gel electrophoresis (FIG. 17B). I622L resulted in a clear decrease in the amount of high molecular weight oligomer present. Thus, I622L is a desirable space-filling substitution for generating ACE2-Ig proteins containing collectrin domains. By contrast, V670L (combined with V647I) resulted in a ladder of high molecular weight oligomers. Comparing the right two lanes on the native gel, it appears that introducing V670I into a background containing I622L/V646I/I679L reduced the presence of high molecular weight oligomers. The same proteins were separated on a non-reducing SDS gel (FIG. 17C). Intriguingly, I622L alone greatly reduced the presence of a single low molecular weight band, which may correspond to a monomer of ACE2-Ig. However, monomers are clearly not seen on the native gels. Without the intention of being limited to any particular theory, the commensurate reduction in the presence of both high molecular weight oligomers and apparent monomers provides a model where the production of high molecular weight oligomers stems from the presence of an odd number of properly-folded collectrin domains in an ACE2 homodimer. In this model, an improperly-folded collectrin domain interferes with the proper formation of the hinge disulfides, possibly due to the improperly-folded collectrin domain interacting with the hinge or forming a disulfide between the hinge and the A714C cysteine, and/or leaving a single properly-folded collectrin domain to dimerize with the collectrin domain of an ACE2-Ig monomer. Thus, stabilizing the collectrin domain, e.g., with I622L, reduces the presence of monomers and high molecular weight oligomers of ACE2-Ig.

Additional combinations of space-filling mutations introduced into the collectrin domain included V620I/V647I and V647I/V700L. These substitutions were introduced in the context of the ACE2-Ig proteins containing K74C/S106C, A342V, A714C, and an IgG2 hinge. In comparison to the control protein, the combination V620I/V647I reduced the amount of high molecular weight oligomers observed by native gel electrophoresis (FIG. 17D). Thus, V620I and/or V647I reduce the presence of high molecular weight oligomers. By contrast, V647I/V700L increased the presence of high molecular weight oligomers (FIG. 17D). Thus, V700L, either alone or in combination with V647I, results in more unwanted formation of high molecular weight oligomers.

Several individual space-filling substitutions in the collectrin domain were introduced in the context of a wild-type ACE2-Ig protein with an IgG1 Fc region. These included. V620L, A650V, and V685L. In comparison to the otherwise-identical control protein with a wild-type collectrin domain, all three of these substitutions reduced the production of unwanted high molecular weight oligomers (FIG. 17E). The reduction in high molecular weight oligomers was similar for V620L and A650V, and this reduction was greater than observed for V685L. Thus, space-filling substitutions in the collectrin domain that reduce the production of unwanted high molecular weight oligomers include: V620L, I622L, A650V, A650I, and V685L.

As a strategy that is complementary to stabilizing the internal hydrophobic core of the collectrin domain with space-filling mutations, hydrophobic amino acids that are solvent-exposed on the surface of the collectrin domain were replaced. This strategy was based in part upon the observation that I695T greatly reduced the formation of unwanted high molecular weight oligomers (FIG. 17A). Referring to TABLE 4, substitutions of hydrophobic amino acids (i.e., A, V, P, I, L, M, F, and W) having the greatest fractional accessible surface area (ASA) were prioritized. Omitting hydrophobic amino acids that are part of the highly-exposed linear peptide region in between the folded collectrin domain and the antibody hinge (i.e., P729, L731, P733, P734, P737, P738, and V739), the hydrophobic amino acids with the highest fractional ASA values in TABLE 4 were P677, M662, L664, and L656. Substitutions introduced at these sites included: M662T, L664G, L664P, and L656S. Inclusion of the substitution L664G resulted in the most substantial reduction of high molecular weight oligomers observed by native gel electrophoresis, and this reduction was greater than that observed with L665P (FIG. 17E). L656S also caused a reduction in high molecular weight oligomers. By contrast, M662T caused an increase in high molecular weight oligomers. However, M662T introduces a potential N-linked glycosylation site, and another substitution, e.g., M662G or M662A, would not. Therefore, substitution of M662 with an amino acid other than S or T or a bulky hydrophobic amino acid may promote the proper folding of the collectrin domain. Thus, as shown herein, hydrophobic residues that are exposed and partially-exposed on the surface of the collectrin domain can be replaced to reduce the formation of unwanted high molecular weight oligomers, including L656, L664, and I695. For example, the substitutions L656S, L664G, and I695T reduce the formation of high molecular weight oligomers.

Figure 18:
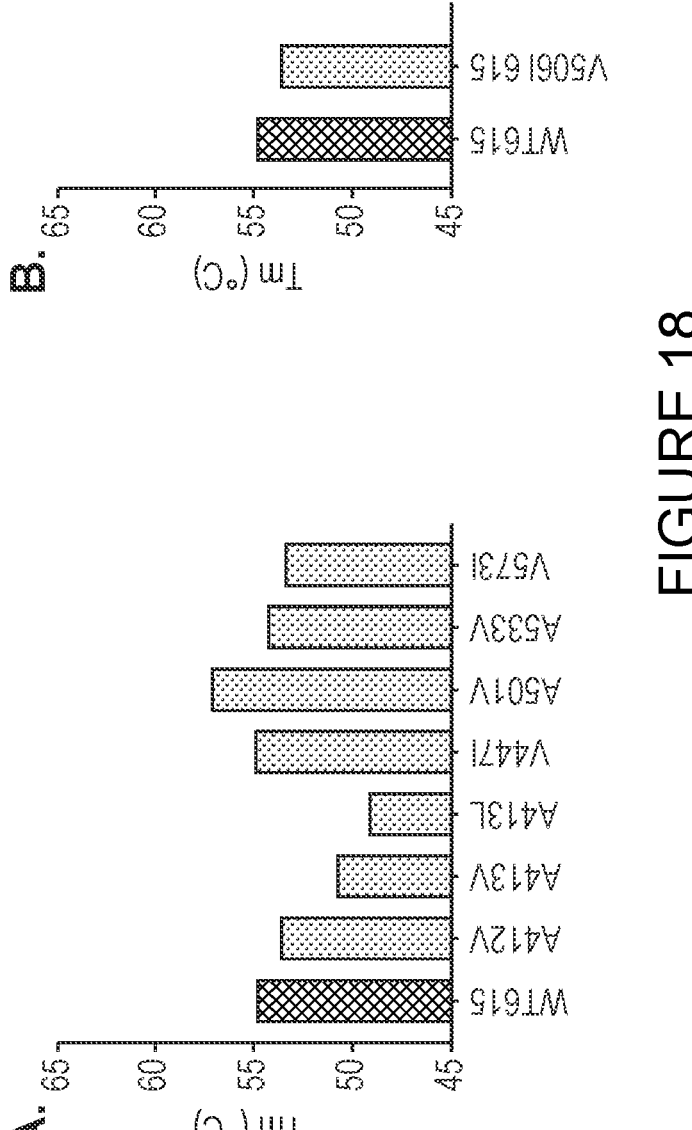
FIGS. 18A-B provides bar graphs of the melting temperatures of ACE2-Ig proteins comprising internal space-filling mutations. In the context of an ACE2-Ig protein comprising amino acids 19-615 of human ACE2 (SEQ ID NO: 1), individual space-filling mutations were evaluated for their effect on thermal stability as measured by DSF. The melting temperatures measured by DSF for an ACE2-Ig with a wild-type ACE2 sequence and the individual space-filling substitutions A412V, A413V, A413L, V447I, A501V, A533V, and V573I are shown in FIG. 18A. The melting temperatures measured by DSF for an ACE2-Ig with a wild-type ACE2 sequence and the individual space-filling substitution V506I are shown in FIG. 18B. Wild-type is abbreviated WT615 (ACE2-Ig protein comprising amino acids 19-615 of human ACE2).

Example 9—Space-Filling Substitutions in Amino Acids 19-615 of ACE2 that Improve Thermal Stability Based in part on the successful application of the strategy of filling internal spaces within the hydrophobic interior of ACE2 observed with the substitutions A25V and A342V, this strategy was extended to additional sites in the region from amino acids 19-615 of human ACE2-Ig (SEQ ID NO. 1). Substitutions were evaluated, including, substitution of a buried amino acid or a partially-buried serine in wild-type human ACE2 (SEQ ID NO: 1) by a threonine, hydrophobic amino acid, or aromatic amino acid having more carbon atoms or a greater molecular weight than the amino acid that is replaced. The sites tested for improving the thermal stability of ACE2-Ig proteins included: A412, A413, V447, A501, V506, A533, and V573. Specifically, the substitutions tested included A412V, A413V, A413L, V447I, A501V, V506I, A533V, and V573I. The thermal stability of these ACE2-Ig muteins was measured by DSF. The greatest improvement in thermal stability was observed for A501V, which increased the melting temperature of an ACE2-Ig protein lacking the collectrin domain by 2.4° C. from 54.8° C. to 57.2° C. (FIG. 18A). The next-greatest increase was a 0.2° C. increase for V447I. Although V506I did not improve the melting temperature measured by DSF (FIG. 18B), it was noted that V506I markedly reduced the background fluorescence in the DSF assay in the temperature range from approximately 25° C. to 50° C. Without wishing to be bound by any particular theory, the reduced background fluorescence may indicate that V506I reduced the structural fluidity of the protein at physiologic temperatures. Thus, space-filling substitutions that improve thermal stability and/or structural fluidity at physiologic temperatures include A342V, V447I, A501V, and V506I.

Example 10—Replacing Hydrophobic Residues Exposed on the Surface of ACE2 Amino Acids 19-615

Figure 19:
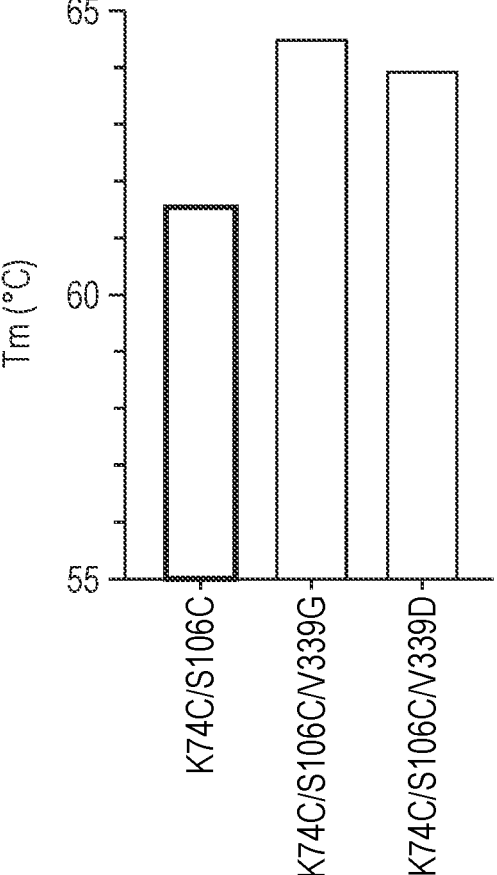
FIG. 19 is a bar graph of the melting temperatures of ACE2-Ig variants showing the effect on thermal stability of the replacement of exposed surface hydrophobic residues. Melting temperatures were measured for ACE2-Ig variants containing K74C/S106C and a collectrin domain with either a wild-type exposed surface hydrophobic residue V339 (first bar), or the substitutions V339G or V339D (second and third bars, respectively).

As a strategy that is complementary to stabilizing the internal hydrophobic core of the region of ACE2, surface-exposed or partially-exposed hydrophobic residues also were replaced in the region from amino acids 19-615 of wild-type human ACE2 (SEQ ID NO. 1). The fractional ASA values of TABLE 4 were sorted from largest to smallest. The hydrophobic amino acids with the greatest fractional ASA values were: A387, V339, A301, and P289. A387 and V339 had fractional ASA values of approximately 1, indicating that their hydrophobic side chains are completely exposed. Because an exposed valine is more unfavorable than an exposed alanine, V339 was substituted first. The substitutions introduced were V339G and V339D, since these exist in the ACE2 proteins of other mammals (FIGS. 2-3). V339G and V339D were evaluated in the context of an ACE2-Ig protein containing K74C/S106C and a collectrin domain. In comparison to the K74C/S106C control, both substitutions markedly increased thermal stability, as measured by DSF (FIG. 19). V339G increased the melting temperatures measured by DSF by 3° C., whereas V339D increased melting temperatures measured by DSF by 2.4° C. Thus, V339 and other exposed hydrophobic residues can be replaced to improve the thermal stability of ACE2, and these substitutions can be combined with space-filling substitutions that stabilize the hydrophobic interior of the protein, such as A342V.

Example 11—Minimizing Cryptic Splicing of ACE2 Pre-mRNA

It was observed that the pre-mRNAs encoding ACE2 muteins underwent deleterious cryptic splicing. RNA transcripts were cloned by RT-PCR using a forward primer 5' of the splice donor of the vector, and a reverse primer between the stop codon and polyadenylation site. Bands from the RT-PCR reaction were visualized on an agarose gel, excised, and cloned using a standard TA cloning kit (TOPO-TA, Life Technologies). The inserts cloned by RT-PCR were then sequenced. This approach identified cryptic splice sites that were being used to generate unwanted variants.

For instance, a cryptic splice acceptor was observed at the codon corresponding to T609. When T609 was encoded by the codon ACA, it formed a CAG splice acceptor consensus motif with the G of the GA(T/C) codon encoding the adjacent amino acid D610. Elimination of this cryptic splicing site eliminated a protein doublet band that had been observed by native gel electrophoresis. Thus, to avoid a cryptic splice site, an ACE2-Ig sequence can use a codon in which the second position is not a T or a C and the third position is not an A to encode for the amino acid corresponding to T609 of human ACE2 (SEQ ID NO: 1).

Also, it was observed that an ACE2-Ig protein containing the collectrin domain that was based on the wild-type endogenous human ACE2 genomic codon sequence had a prominent cryptic splice acceptor site at the AG splice acceptor dinucleotide motif of the AGA codon encoding R697. Thus, polynucleotides encoding ACE2 proteins containing a collectrin domain may be designed to avoid the splice acceptor site at or around the codon encoding R697. For example, the codon CCA or CCG can be used instead of a CCC or CCT codon to encode for P696 (to avoid creating a CAG or TAG splice acceptor motif). Alternatively, or in addition, the codon CGC, CGT, CGA, or CGG can be used instead of a AGA or AGG to encode R697. Also in certain embodiments, the sequence encoding ACE2-Ig is not based on the natural human codon usage. The nucleotide "T" is used in the present example in reference to codons present in DNA. However, as the skilled artisan recognizes, a "U" nucleotide is substituted in place of a "T" nucleotide in RNA.

It was observed that the introduction of the substitution A25V resulted in the creation of a functional splice donor sequence. Sequences cloned from RT-PCR reactions from an ACE2-Ig variant containing the substitution A25V were aligned to the expected pre-mRNA sequence (FIG. 20). As shown, the codon encoding the amino acid at the position corresponding to Q24 of wild-type human ACE2 (SEQ ID NO: 1) was CAG, and the valine at position 25 was encoded by GTC, forming CAG-GTC, which contains the splice donor motif GGT or AGGT. Thus, it was discovered that a cryptic splice site can be avoided in sequences encoding ACE2 muteins containing a valine at the position corresponding to A25 (i.e., A25V), if the CAG codon encoding the amino acid at a position corresponding to Q24 of human ACE2 (SEQ ID NO: 1) is changed to another codon, such as CAA.

Based on the discovery that ACE2-Ig sequences were prone to excessive splicing, an intron was engineered into the middle of the ACE2-Ig sequence. The ACE2-Ig expression cassettes previously used contained one intron, which was 5' to the start codon of the ACE2-Ig open reading frame (ORF), and which was either an HTLV-1 intron or an SV40 intron. A plasmid comprising a nucleotide sequence encoding an ACE2-Ig protein comprising a collectrin domain and the substitutions K74C/S106C/A342V/I622L/I695T/A714C (SEQ ID NO: 67) was modified to include an HTLV-1 intron sequence in between K619 and V620, thereby generating SEQ ID NO: 68. The location for the intron was chosen, in part, due to existing 5' sequences encoding dimerization domains (i.e., the collectrin domain and the Fc). In addition, a stop codon was engineered into the intron sequence immediately 3' of the consensus splice donor motif. Thus, any proteins translated from an RNA where the HTLV-1 internal intron is not appropriately spliced out would terminate a few amino acids C-terminal to the end of the first 615 amino acids of ACE2 thereby generating an ACE2 monomer.

Figure 21:
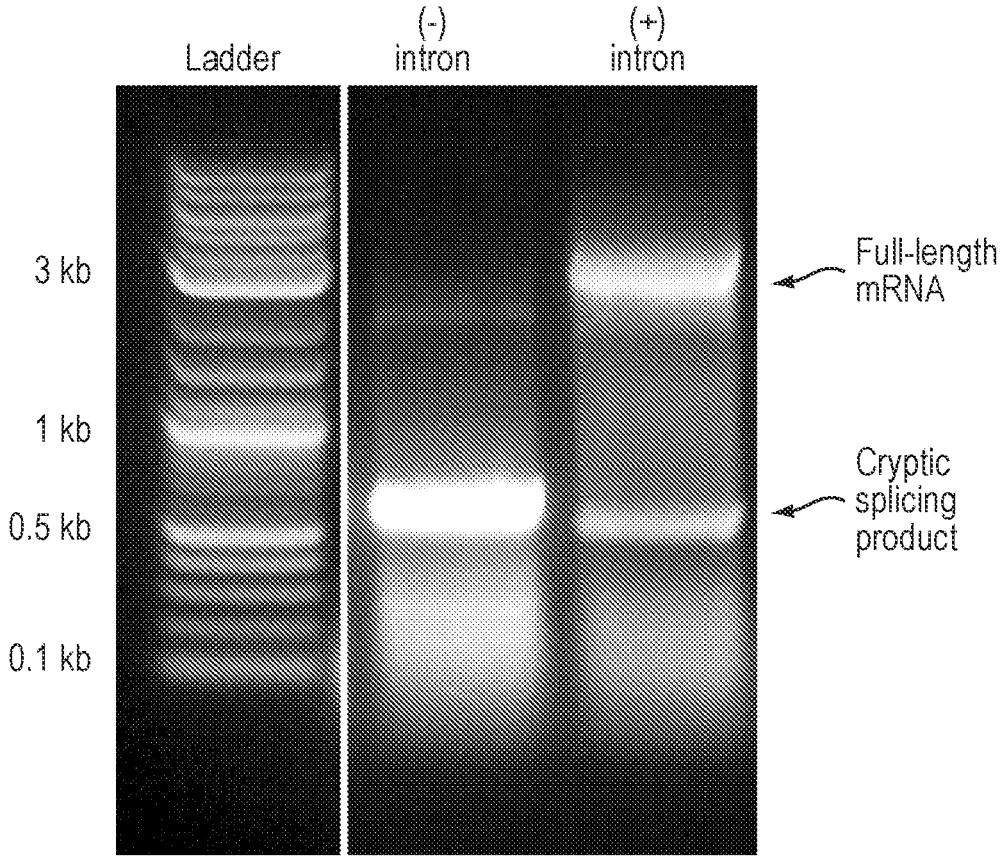
FIG. 21 is an agarose gel showing RT-PCR products of ACE2-Ig genes with and without a second intron. Spliced mRNA transcripts were amplified by RT-PCR using a forward primer between the transcriptional start site and the upstream splice donor, and a reverse primer just 5' of the polyadenylation site. The RT-PCR fragments were separated by gel electrophoresis on the agarose gel shown. "(+) intron" indicates the RT-PCR product of the ACE2-Ig with a second intron that separates the ACE2-Ig coding region into two exons, and "(−) intron indicates the RT-PCR product of the ACE2-Ig lacking this second intron.

The inclusion of this second intron, which was placed in between two exons encoding the ACE2-Ig protein, greatly reduced cryptic splicing. Spliced mRNA transcripts were amplified by RT-PCR using a forward primer between the transcriptional start site and the upstream splice donor, and a reverse primer just 5' of the polyadenylation site. The RT-PCR fragments were analyzed by agarose gel electrophoresis (FIG. 21). A dramatic reduction was observed in the ~1 kb cryptically-spliced product, and a corresponding increase was observed in the ~3 kb full-length product. Thus, the inclusion of a second intron, which separates the coding region of ACE2-Ig into two exons, greatly improved the expression of a full-length ACE2-Ig mRNA.

The inclusion of an intron led to improved protein expression. In comparison to the otherwise identical nucleotide sequence lacking the intron (SEQ ID NO: 67), the sequence comprising the intron expressed ACE2-Ig at nearly double the yield (an 87% increase, from 46.6 to 87.0 mg/L) by transient transfection of CHO cells (TABLE 14). Thus, expression of an ACE2-Ig protein can be increased when the nucleotide sequence encoding the ACE2-Ig protein comprises at least two exons separated by at least one intron. In other words, the expression of an ACE2-Ig protein can be increased when the nucleic acid encoding it comprises two or more introns.

TABLE 14

| ACE2-Ig Motein | Yield (mg/L) |
|---|---|
| K74C/S106C/A342V/I622L/I695T/A714C ACE2-C-Ig (SEQ ID NO: 67) | 46.6 |
| K74C/S106C/A342V/I622L/I695T/A174C ACE2-C-Ig + intron (SEQ ID NO: 68) | 87.0 |

Example 12—Reducing Aggregation by Closing the Substrate-Binding Cleft

Closing the substrate-binding cleft was observed to reduce aggregation and improve the fidelity of protein folding. In the context of an ACE2-Ig mutein with engineered cysteines disposed on opposite sides of the substrate-binding cleft (K74C and S106C), either the ACE2 inhibitor MLN-4760 or the substitution H345Y greatly reduced the production of aggregates (FIG. 22A). Indeed H345Y appeared to reduce the formation of aggregates beyond that achieved by MLN-4760. Thus, closing the substrate-binding cleft with an ACE2 inhibitor (e.g., MLN-4760) or H345Y, in the context of engineered cysteines disposed on opposite sides of the substrate-binding cleft (e.g., K74C and S106C), reduces aggregation.

Example 13—SARS-CoV-2 Neutralization by ACE2-Ig Proteins with Closed Substrate-Binding Clefts Closing the substrate-binding cleft does not affect the potency with which ACE2-Ig neutralizes SARS-CoV-2. ACE2-Ig proteins without any engineered cysteine residues disposed on opposite sides of the substrate-binding cleft (wild-type), with the K74C/S106C cysteine substitutions, or with the K74C/S106C and S128C/V343C cysteine substitutions, were produced in the presence and absence of the ACE2 inhibitor MLN-4760. These proteins, produced in the presence and absence of MLN-4760, were tested for neutralization of SARS-CoV-2 pseudoviruses (FIG. 22B). No differences in virus neutralization were observed. Therefore, closing of the substrate-binding cleft, e.g., with an ACE2 inhibitor, K74C/S106C, and/or S128C/V343C, does not affect the ability of ACE2-Ig to neutralize virus infectivity.

Example 14—Further Optimization of ACE2 Protein Fidelity and Stability

Figure 23:
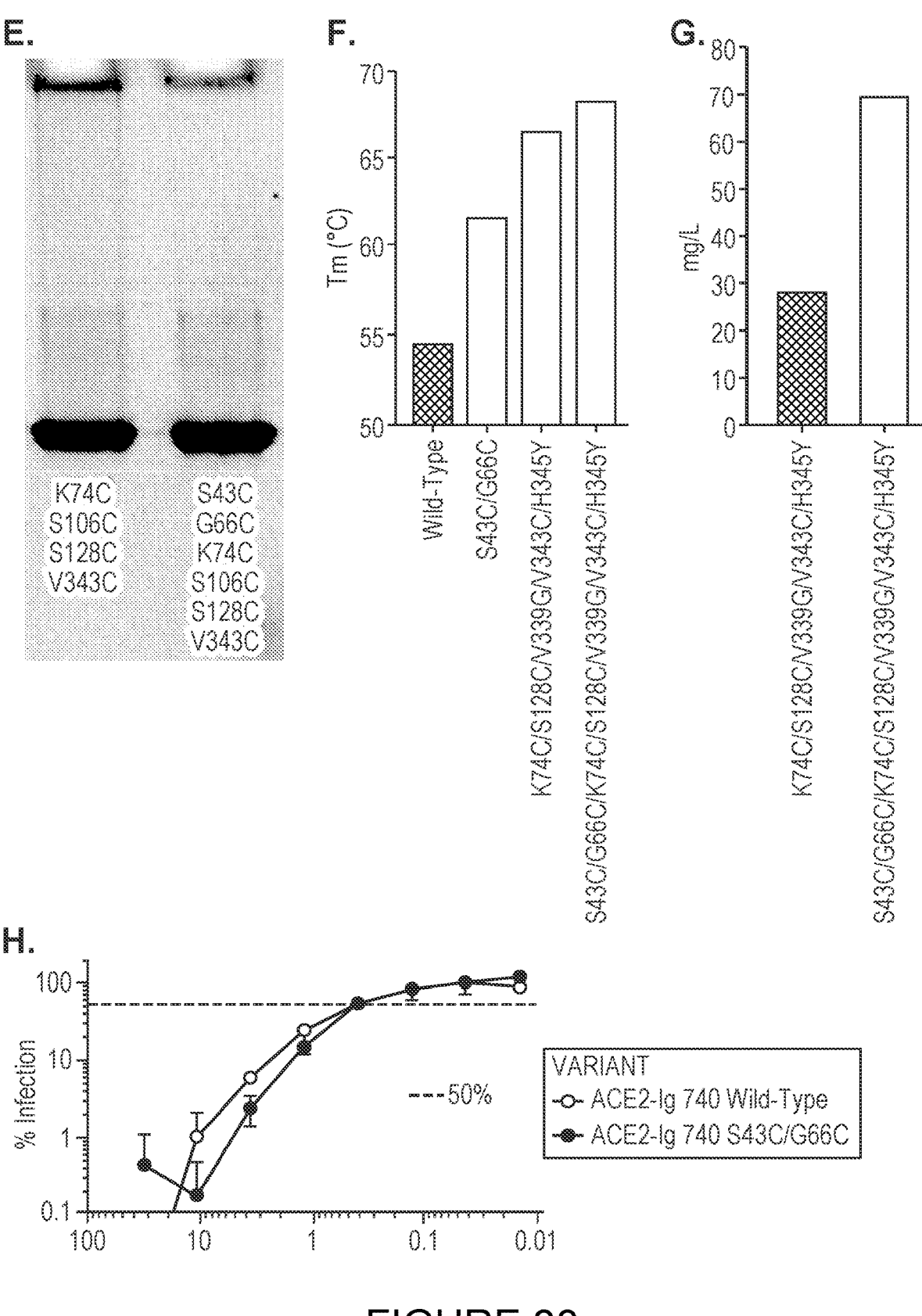
FIGS. 23A-I show native protein gels, stability, yield, and neutralization data for ACE2-Ig optimization variants. Differences in aggregation due to substitutions in the collectrin domain, including A714C, I695T, and I622L were evaluated by native protein gel electrophoresis (FIG. 23A). Substitutions at M662 of the collectrin domain were evaluated by native protein gel electrophoresis (FIG. 23B). Substitutions at V647 and A650I of the collectrin domain were evaluated by native protein gel electrophoresis (FIG. 23C). Cysteine substitutions at C498 were evaluated for their potential to reduce protein aggregation by native protein gel electrophoresis (FIG. 23D). The effect of the cysteine substitutions, S43C/G66C, which potentially form a disulfide, on protein aggregation was evaluated by native protein gel electrophoresis (FIG. 23E). The effect of S43C/G66C on protein stability, assayed by DSF, is shown as a bar graph of melting temperatures (FIG. 23F). Protein yield ACE2-Ig variants with and without S43C/G66C is shown as a bar graph (FIG. 23G). The potential impact of S43C/G66C on SARS-CoV-2 pseudovirus neutralization was assessed (FIG. 23H). The potential for aggregation of ACE2-Ig proteins containing the substitutions A25V/S43C/G66C/K74C/N90D/S128C/I259T/C261P/V339G/A342V/V343C/H345Y/C498M/I622L/I695T/A714C, with or without the additional substitutions H374C/G405C, was assessed by native protein gel electrophoresis (FIG. 23I).
Figure 23:
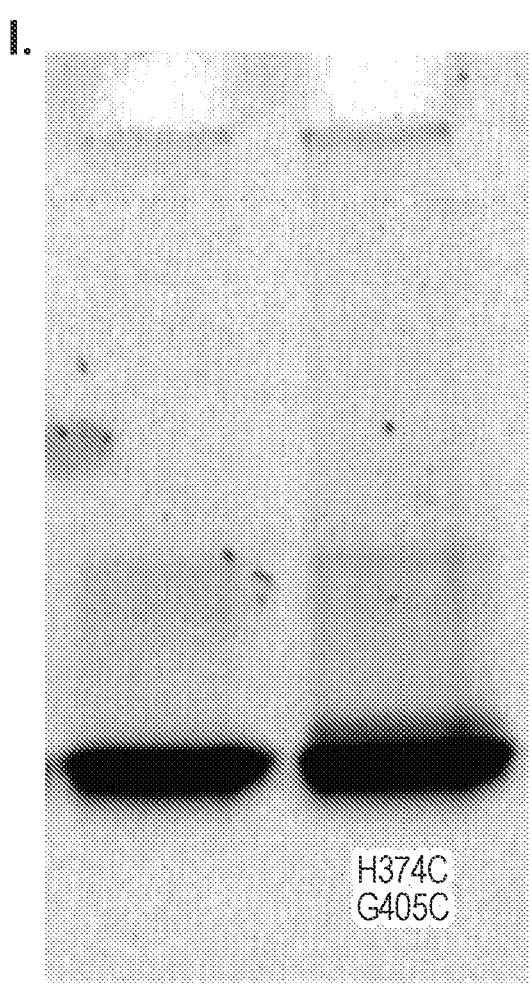

The ACE2-Ig protein underwent further optimization, in order to improve folding fidelity, aggregation, stability and yields. These efforts first focused on the collectrin domain. Introducing A714C resulted in increased aggregation, at least as was observed on a native gel (FIG. 23A). In the context of A714C, several combination variants were evaluated. K74C/S106C reduced the number of aggregates detectable. Next, the introduction of I695T substantially improved protein folding fidelity and reduced aggregation. Without wishing to be bound by one particular theory, I695T may function by redistributing hydrophobicity away from the surface of the collectrin domain. The further introduction of I622L in the context of K74C/S106C and I695T appeared to modestly reduce aggregation. Thus, I695T provides a substantial improvement in the folding fidelity and aggregation of ACE2-Ig muteins containing a collectrin domain.

Substitutions were evaluated at M662, as additional substitutions that redistribute hydrophobicity away from the surface of the collectrin domain. Indeed, M662G and M662D reduced the aggregation and improved the protein folding fidelity of ACE2-Ig (FIG. 23B). Without wishing to be bound by any particular theory, M662G and M662D may function by redistributing hydrophobicity away from the surface and towards the interior of the collectrin domain.

Additional space-filling substitutions that redistribute hydrophobicity towards the interior of the collectrin domain were evaluated. V647L and A650I each reduced protein aggregation, with A650I having the larger effect (FIG. 23C). In both of these cases, the amino acid that was replaced has fewer carbon atoms and is smaller than its replacement. Without wishing to be bound by a particular theory, at least A650I may function by redistributing hydrophobicity towards the interior of the collectrin domain.

Cysteine amino acid substitutions were evaluated at position C498 in the protease domain of ACE2-Ig. These were evaluated in the context of an ACE2-Ig containing the substitutions A25V/S43C/G66C/C133S/C141S/S128C/V339G/A342V/V343C/I622L/I695T. The conservative substitution C498S and the substitution C498A did not improve protein fidelity and aggregation (FIG. 23D). However, the space-filling substitution C498M, where methionine, which contains more carbon atoms and is a larger residue than cysteine, improved protein folding fidelity and reduced aggregation.

Cysteine amino acid substitutions were evaluated at S43 and G66. The cysteine amino acid substitutions S43C and G66C appeared to reduce the amount of aggregated protein that did not enter a native protein gel in the context of an ACE2-Ig protein containing the substitutions K74C/S106C/S128C/A342V/V343C/H345Y/I622L/I695T, which function to close the substrate-binding cleft (FIG. 23E). Therefore, S43C/G66C appeared to reduce aggregation of this protein. The melting temperatures measured by DSF also showed that S43C/G66C improved conformational stability (FIG. 23F). In the context of a wild-type human ACE2 (amino acids 19-740 of SEQ ID NO: 1) background, containing the collectrin domain, S43C/G66C improved melting temperatures by 7.3° C., which is a substantial improvement, from 54.6° C. to 61.9° C. (FIG. 23F). In the context of a more stabilized background containing A25V/K74C/N90D/S128C/V339G/A342V/V343C/H345Y/I622L/I695T, S43C/G66C improved the melting temperature measured by DSF by 1.5° C. from 66.8° C. to 68.3° C. Notably, even though the potential disulfide introduced with S43C/G66C is near contacts with the SARS-CoV-2 RBD, neutralization of SARS-CoV-2 by an ACE2-Ig protein was unaffected by the presence or absence of the substitutions S43C/G66C (FIG. 23H). Thus, S43C/G66C stabilizes ACE2 without impacting virus neutralization.

Building on these data, additional variants were generated that further improved protein folding fidelity and reduced potential for aggregation. These variants had the substitutions A25V/S43C/G66C/K74C/N90D/S128C/I259T/C261P/V339G/A342V/V343C/H345Y/C498M/I622L/I695T, with or without the additional pair of cysteine substitutions H374C/G405C. The pair of substitutions H347C/G405C inactivates the enzymatic active site. ACE2-Ig proteins containing A25V/S43C/G66C/K74C/N90D/S128C/I259T/C261P/V339G/A342V/V343C/H345Y/C498M/I622L/I695T, with or without the additional pair of cysteine substitutions H374C/G405C, exhibited remarkably low aggregation observable by native protein gel electrophoresis (FIG. 23I). These ACE2-Ig proteins with and without the H374C/G405C substitutions had melting temperatures measured by DSF of 65.9° C. and 69.6° C., respectively. Thus, the combination of substitutions A25V/S43C/G66C/K74C/N90D/S128C/I259T/C261P/V339G/A342V/V343C/H345Y/C498M/I622L/I695T yielded a stable ACE2-Ig protein.

Example 15—Pharmacokinetics (PK) of ACE2-Ig Proteins

Figure 24:
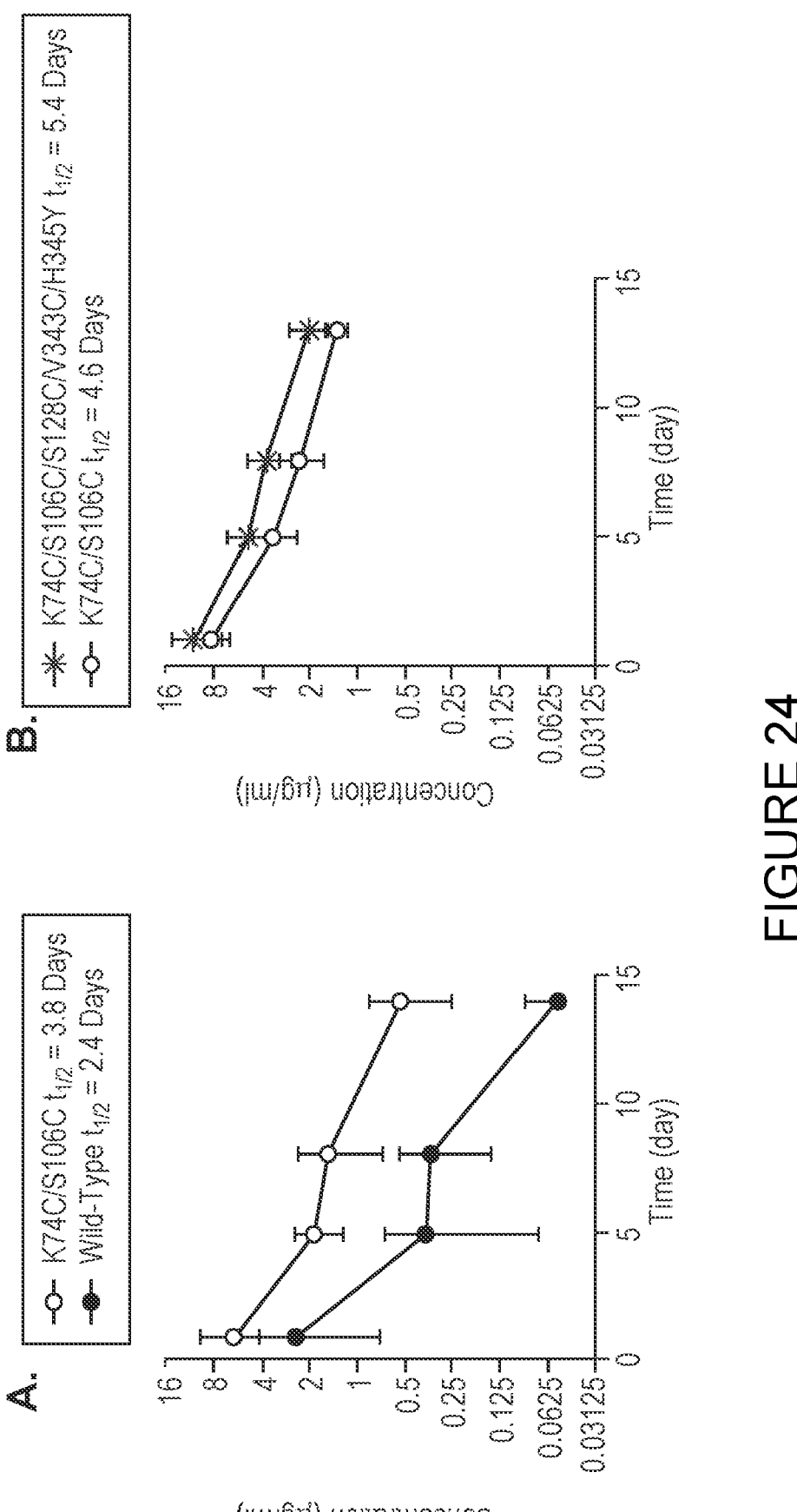
FIGS. 24A-B show line graphs of the data from experiments evaluating the pharmacokinetics of ACE2-Ig proteins in human FcRn transgenic mice. In each experiment, the ACE2-Ig protein was administered to the mice i.v. by tail vein injection at 10 mg/kg. These pharmacokinetics (PK) experiments were conducted in the context of the background set of substitutions A25V/L29F/N90D/C131S/C141S/A342V/A386L/A714C. The impact on PK of the combination of cysteine substitutions K74C/S106C, which are disposed on opposite sides of the substrate-binding cleft, was evaluated (FIG. 24A). The PK of the ACE2-Ig variant containing K74C/S106C was compared with the PK of the variant containing the additional substitutions S128C/V343C/H345Y (FIG. 24B). Calculated plasma half-lives are shown.

The pharmacokinetics of ACE2-Ig proteins with substitutions that close the substrate-binding cleft were evaluated. Human FcRn-transgenic mice received intravenous (i.v.) doses of ACE2-Ig proteins at 10 mg/kg by tail vein injection. These PK experiments were conducted in a background of the substitutions A25V/L29F/N90D/C131S/C141S/A342V/A386L/A714C. The inclusion of a single pair of engineered cysteines disposed on opposite sides of the substrate-binding cleft (K74C and S106C) significantly improved the PK of ACE2-Ig relative to a control that was wild-type at these positions (FIG. 24A). The introduction of the pair of cysteine substitutions K74C and S106C increased the half-life of the protein from 2.4 days to 3.8 days. Next, the PK of the same protein containing the K74C/S106C substitutions was compared against an ACE2-Ig variant with two additional engineered cysteines, each disposed on opposite sides of the substrate-binding cleft (S128C and V343C) (FIG. 24B). This variant, which contained K74C/S106C/S128C/V343C additionally contained H345Y, which is a substitution that functions to promote the closure of the substrate-binding cleft. The ACE2-Ig protein containing K74C/S106C/S128C/V343C/H345Y exhibited improved PK, with a half-life of 5.4 days versus a half-life of 4.6 days observed for the ACE2-Ig protein with only K74C/S106C. Thus, promoting the closure of the substrate-binding cleft through the introduction of two pairs of cysteine substitutions disposed on opposite sides of the substrate-binding cleft, in combination with H345Y, improved the PK of ACE2-Ig.

INCORPORATION BY REFERENCE

The entire disclosure of each of the patent and scientific documents referred to herein is incorporated by reference for all purposes.

EQUIVALENTS

The invention may be embodied in other specific forms without departing from the spirit or essential characteristics thereof. The foregoing embodiments are therefore to be considered in all respects illustrative rather than limiting on the invention described herein. Scope of the invention is thus indicated by the appended claims rather than by the foregoing description, and all changes that come within the meaning and range of equivalency of the claims are intended to be embraced therein.

```
SEQUENCE LISTING
(human ACE2, entire sequence)
                                   SEQ ID NO: 1
MSSSSWLLLSLVAVTAAQSTIEEQAKTFLDKFNHEAEDLFYQSSL

ASWNYNTNITEENVQNMNNAGDKWSAFLKEQSTLAQMYPLQEIQN

LTVKLQLQALQQNGSSVLSEDKSKRLNTILNTMSTIYSTGKVCNP

DNPQECLLLEPGLNEIMANSLDYNERLWAWESWRSEVGKQLRPLY

EEYVVLKNEMARANHYEDYGDYWRGDYEVNGVDGYDYSRGQLIED

VEHTFEEIKPLYEHLHAYVRAKLMNAYPSYISPIGCLPAHLLGDM

WGRFWTNLYSLTVPFGQKPNIDVTDAMVDQAWDAQRIFKEAEKFF

VSVGLPNMTQGFWENSMLTDPGNVQKAVCHPTAWDLGKGDFRILM

CTKVTMDDFLTAHHEMGHIQYDMAYAAQPFLLRNGANEGFHEAVG

EIMSLSAATPKHLKSIGLLSPDFQEDNETELNFLLKQALTLVGTL

PHTYMLEKWRWMVFKGELPKDQWMKKWWEMKRELVGVVEPVPHDE

TYCDPASLFHVSNDYSFTRYYTRTLYQFQFQEALCQAAKHEGPLH

KCDISNSTEAGQKLFNMLRLGKSEPWTLALENVVGAKNMNVRPLL

NYFEPLFTWLKDQNKNSFVGWSTDWSPYADQSIKVRISLKSALGD

KAYEWNDNEMYLFRSSVAYAMRQYFLKVKNQMILFGEEDVRVANL

KPRISFNFFVTAPKNVSDIIPRTEVEKAIRMSRSRINDAFRLNDN

SLEFLGIQPTLGPPNQPPVSIWLIVFGVVMGVIVVGIVILIFTGI

RDRKKKNKARSGENPYASIDISKGENNPGFQNTDDVQTSF (IgG1 lower hinge)
                                   SEQ ID NO: 2
CPAPELL (IgA1 hinge)
                                   SEQ ID NO: 3
PVPSTPPTPSPSTPPTPSPSCCHPRLSLHRPALEDLLL (IgA2 hinge)
                                   SEQ ID NO: 4
RVPPPPPCCHPRLSLHRPALEDLLL (IgG1 hinge)
                                   SEQ ID NO: 5
VEPKSCDKTHTCPPCPAPELL (IgG2 hinge
                                   SEQ ID NO: 6
VDKTVERKCCVECPPCPAPPVA (IgG3 hinge)
                                   SEQ ID NO: 7
DKRVELKTPLGDTTHTCPRCPEPKSCDTPPPCPRCPEPKSCDTPP

PCPRCPEPKSCDTPPPCPRCPAPELL
```

```
(IgG4 hinge)
                                   SEQ ID NO: 8
VDKRVESKYGPPCPSCPAPEFL (IgG2 lower hinge)
                                   SEQ ID NO: 9
CPAPPV (IgG4 lower hinge)
                                   SEQ ID NO: 10
CPAPEFL (IgG1 L234A/L235A "LALA" lower hinge)
                                   SEQ ID NO: 11
CPAPEAA (ACE2-Ig, IgG1 hinge junction sequence)
                                   SEQ ID NO: 12
YADQSSDKTHTCPPC (ACE2-Ig, IgG2 hinge junction sequence)
                                   SEQ ID NO: 13
YADQSSVECPPC (ACE2-Ig, IgA1/IgG2 hinge junction sequence)
                                   SEQ ID NO: 14
YADQSPSTPPTPSPSCCVECPPC (ACE2-C-Ig, wild-type collectrin hinge junction
sequence)
                                   SEQ ID NO: 15
PPNQPPVECPPC (O-linked glycosylation site)
                                   SEQ ID NO: 16
NNSS (O-linked glycosylation site)
                                   SEQ ID NO: 17
NNST (O-linked glycosylation site)
                                   SEQ ID NO: 18
NNTS (O-linked glycosylation site)
                                   SEQ ID NO: 19
NNTT (IgG1 constant regions)
                                   SEQ ID NO: 20
ASTKGPSVFPLAPSSKSTSGGTAALGCLVKDYFPEPVTVSWNSGA

LTSGVHTFPAVLQSSGLYSLSSVVTVPSSSLGTQTYICNVNHKPS

NTKVDKKVEPKSCDKTHTCPPCPAPELLGGPSVFLFPPKPKDTLM

ISRTPEVTCVVVDVSHEDPEVKFNWYVDGVEVHNAKTKPREEQYN

STYRVVSVLTVLHQDWLNGKEYKCKVSNKALPAPIEKTISKAKGQ

PREPQVYTLPPSRDELTKNQVSLTCLVKGFYPSDIAVEWESNGQP

ENNYKTTPPVLDSDGSFFLYSKLTVDKSRWQQGNVFSCSVMHEAL

HNHYTQKSLSLSPGK (IgG2 constant regions)
                                   SEQ ID NO: 21
ASTKGPSVFPLAPCSRSTSESTAALGCLVKDYFPEPVTVSWNSGA

LTSGVHTFPAVLQSSGLYSLSSVVTVPSSNFGTQTYTCNVDHKPS

NTKVDKTVERKCCVECPPCPAPPVAGPSVFLFPPKPKDTLMISRT

PEVTCVVVDVSHEDPEVQFNWYVDGVEVHNAKTKPREEQFNSTFR

VVSVLTVVHQDWLNGKEYKCKVSNKGLPAPIEKTISKTKGQPREP

QVYTLPPSREEMTKNQVSTTCLVKGFYPSDTSVEWESNGQPENNY
```

-continued

KTTPPMLDSDGSFFLYSKLTVDKSRWQQGNVFSCSVMHEALHNHY

TQKSLSLSPGK (IgG3 constant regions)
                                        SEQ ID NO: 22
ASTKGPSVFPLAPCSRSTSGGTAALGCLVKDYFPEPVTVSWNSGA

LTSGVHTFPAVLQSSGLYSLSSVVTVPSSSLGTQTYTCNVNHKPS

NTKVDKRVELKTPLGDTTHTCPRCPEPKSCDTPPPCPRCPEPKSC

DTPPPCPRCPEPKSCDTPPPCPRCPAPELLGGPSVFLFPPKPKDT

LMISRTPEVTCVVVDVSHEDPEVQFKWYVDGVEVHNAKTKPREEQ

YNSTFRVVSVLTVLHQDWLNGKEYKCKVSNKALPAPIEKTISKTK

GQPREPQVYTLPPSREEMTKNQVSLTCLVKGFYPSDIAVEWESSG

QPENNYNTTPPMLDSDGSFFLYSKLTVDKSRWQQGNIFSCSVMHE

ALHNRFTQKSLSLSPGK (IgG4 constant regions)
                                        SEQ ID NO: 23
ASTKGPSVFPLAPCSRSTSESTAALGCLVKDYFPEPVTVSWNSGA

LTSGVHTFPAVLQSSGLYSLSSVVTVPSSSLGTKTYTCNVDHKPS

NTKVDKRVESKYGPPCPSCPAPEFLGGPSVFLFPPKPKDTLMISR

TPEVTCVVVDVSQEDPEVQFNWYVDGVEVHNAKTKPREEQFNSTY

RVVSVLTVLHQDWLNGKEYKCKVSNKGLPSSIEKTISKAKGQPRE

PQVYTLPPSQEEMTKNQVSLTCLVKGFYPSDIAVEWESNGQPENN

YKTTPPVLDSDGSFFLYSRLTVDKSRWQEGNVFSCSVMHEALHNH

YTQKSLSLSLGK

SEQ ID NO: 24
(IgD constant regions)
APTKAPDVFPIISGCRHPKDNSPVVLACLITGYHPTSVTVTWYMG

TQSQPQRTFPEIQRRDSYYMTSSQLSTPLQQWRQGEYKCVVQHTA

SKSKKEIFRWPESPKAQASSVPTAQPQAEGSLAKATTAPATTRNT

GRGGEEKKKEKEKEEQEERETKTPECPSHTQPLGVYLLTPAVQDL

WLRDKATFTCFVVGSDLKDAHLTWEVAGKVPTGGVEEGLLERHSN

GSQSQHSRLTLPRSLWNAGTSVTCTLNHPSLPPQRLMALREPAAQ

APVKLSLNLLASSDPPEAASWLLCEVSGFSPPNILLMWLEDQREV

NTSGFAPARPPPQPRSTTFWAWSVLRVPAPPSPQPATYTCVVSHE

DSRTLLNASRSLEVSYVTDHGPMK (IgM constant regions)
                                        SEQ ID NO: 25
GSASAPTLFPLVSCENSPSDTSSVAVGCLAQDFLPDSITFSWKYK

NNSDISSTRGFPSVLRGGKYAATSQVLLPSKDVMQGTDEHVVCKV

QHPNGNKEKNVPLPVIAELPPKVSVFVPPRDGFFGNPRKSKLICQ

ATGFSPRQIQVSWLREGKQVGSGVTTDQVQAEAKESGPTTYKVTS

TLTIKESDWLGQSMFTCRVDHRGLTFQQNASSMCVPDQDTAIRVF

AIPPSFASIFLTKSTKLTCLVTDLTTYDSVT1SWTRQNGEAVKTH

TNISESHPNATFSAVGEASICEDDWNSGERFTCTVTHTDLPSPLK

QTISRPKGVALHRPDVYLLPPAREQLNLRESATITCLVTGFSPAD

-continued

VFVQWMQRGQPLSPEKYVTSAPMPEPQAPGRYFAHSTLTVSEEEW

NTGETYTCWAHEALPNRVTERTVDKSTGKPTLYNVSLVMSDTAGT

CY (IgA1 constant regions)
                                        SEQ ID NO: 26
ASPTSPKVFPLSLCSTQPDGNVVIACLVQGFFPQEPLSVTWSESG

QGVTARNFPPSQDASGDLYTTSSQLTLPATQCLAGKSVTCHVKHY

TNPSQDVTVPCPVPSTPPTPSPSTPPTPSPSCCHPRLSLHRPALE

DLLLGSEANLTCTLTGLRDASGVTFTWTPSSGKSAVQGPPERDLC

GCYSVSSVLPGCAEPWNHGKTFTCTAAYPESKTPLTATLSKSGNT

FRPEVHLLPPPSEELALNELVTLTCLARGFSPKDVLVRWLQGSQE

LPREKYLTWASRQEPSQGTTTFAVTSILRVAAEDWKKGDTFSCMV

GHEALPLAFTQKTIDRLAGKPTHVNVSVVMAEVDGTCY (IgA2 constant regions)
                                        SEQ ID NO: 27
ASPTSPKVFPLSLDSTPQDGNVVVACLVQGFFPQEPLSVTWSESG

QNVTARNFPPSQDASGDLYTTSSQLTLPATQCPDGKSVTCHVKHY

TNSSQDVTVPCRVPPPPPCCHPRLSLHRPALEDLLLGSEANLTCT

LTGLRDASGATFTWTPSSGKSAVQGPPERDLCGCYSVSSVLPGCA

QPWNHGETFTCTAAHPELKTPLTANITKSGNTFRPEVHLLPPPSE

ELALNELVTLTCLARGFSPKDVLVRWLQGSQELPREKYLTWASRQ

EPSQGTTTYAVTSILRVAAEDWKKGETFSCMVGHEALPLAFTQKT

IDRMAGKPTHINVSVVMAEADGTCY (ACE2-Ig mutein with an IgA1 upper hinge fused
to an IgG2 hinge)
                                        SEQ ID NO: 28
MSSSSWELLSLVAVTAAQSTIEEQAKTFLDKFNHEAEDLFYQSSL

ASWNYNTNITEENVQNMNNAGDKWSAFLKEQSTLAQMYPLQEIQN

LTVKLQLQALQQNGSSVLSEDKSKRLNTILNTMSIIYSTGKVCNP

DNPQECLLLEPGLNELMANSLDINERLWAWESWRSEVGKQLRPLY

EEYVVLKNEMARANHYEDYGDYWRGDYEVNGVDGYDYSRGQLIED

VEHTFEEIKPLYEHLHAYVRAKLMNAYPSYISPIGCLPAHLLGDM

WGRFWTNLYSLTVPFGQKPNIDVTDAMVDQAWDAQRIFKEAEKFF

VSVGLPNMTQGFWENSMLTDPGNVQKAVCHPTAWDLGKGDFRILM

CTKVTMDDFLTAHHEMGNIQYDMAYAAQPFLLRNGANEGFHEAVG

EIMSLSAATPKHLKSIGLLSPDFQEDNETEINFLLKQALTIVGTL

PFTYMLEKWRWMVFKGEIPKDQWMKKWWEMKREIVGVVEPVPHDE

TYCDPASLFHVSNDYSFIRYYTRTLYQFQFQEALCQAAKHEGPLH

KCDISNSTEAGQKLFNMLRLGKSEPWTLALENVVGAKNMNVRPLL

NYFEPLFTWLKDQNKNSFVGWSTDWSPYADQSPSTPPTPSPSCCV

ECPPCPAPPVAGPSVFLFPPKPKDTLMISRTPEVTCVVVDVSHED

PEVQFNWYVDGVEVHNAKTKPREEQFNSTFRVVSVLTVVHQDWLN

GKEYKCKVSNKGLPAPIEKTISKTKGQPREPQVYTLPPSREEMTK

-continued

NQVSLTCLVKGFYPSDISVEWESNGQPENNYKTTPPMLDSDGSFF

LYSKLTVDKSRWQQGNVFSCSVLHEALHSHYTQKSLSLSPGK (ACE2-Ig mutein with a CD5 signal peptide and an
IgA1 upper hinge fused to an IgG2 hinge)

SEQ ID NO: 29

MPMGSLQPLATLYLLGMLVASVLAQSTIEEQAKTFLDKFNHEAED

LFYQSSLASWNYNTNITEENVQNMNNAGDKWSAFLKEQSTLAQMY

PLQEIQNLTVKLQLQALQQNGSSVLSEDKSKRLNTILNTMSTIYS

TGKVCNPDNPQECLLLEPGLNEIMANSLDYNERLWAWESWRSEVG

KQLRPLYEEYVVLKNEMARANHYEDYGDYWRGDYEVNGVDGYDYS

RGQLIEDVEHTFEEIKPLYEHLHAYVRAKLMNAYPSYISPIGCLP

AHLLGDMWGRFWTNLYSLTVPFGQKPNIDVTDAMVDQAWDAQRIF

KEAEKFFVSVGLPNMTQGFWENSMLTDPGNVQKAVCHPTAWDLGK

GDFRILMCTKVTMDDFLTAHHEMGNIQYDMAYAAQPFLLRNGANE

GFHEAVGEIMSLSAATPKHLKSIGLLSPDFQEDNETEINFLLKQA

LTIVGTLPFTYMLEKWRWMVFKGEIPKDQWMKKWWEMKREIVGVV

EPVPHDETYCDPASLFHVSNDYSFIRYYTRTLYQFQFQEALCQAA

KHEGPLHKCDISNSTEAGQKLFNMLRLGKSEPWTLALENVVGAKN

MNVRPLLNYFEPLFTWLKDQNKNSFVGWSTDWSPYADQSPSTPPT

PSPSCCVECPPCPAPPVAGPSVFLFPPKPKDTLMISRTPEVTCVV

VDVSHEDPEVQFNWYVDGVEVHNAKTKPREEQFNSTFRVVSVLTV

VHQDWLNGKEYKCKVSNKGLPAPIEKTISKTKGQPREPQVYTLPP

SREEMTKNQVSLTCLVKGFYPSDISVEWESNGQPENNYKTTPPML

DSDGSFFLYSKLTVDKSRWQQGNVFSCSVLHEALHSHYTQKSLSL

SPGK (ACE2-Ig mutein with a CD5 signal peptide and
an IgG1 hinge)

SEQ ID NO: 30

MPMGSLQPLATLYLLGMLVASVLAQSTIEEQAKTFLDKFNHEAED

LFYQSSLASWNYNTNITEENVQNMNNAGDKWSAFLKEQSTLAQMY

PLQEIQNLTVKLQLQALQQNGSSVLSEDKSKRLNTILNTMSTIYS

TGKVCNPDNPQECLLLEPGLNEIMANSLDYNERLWAWESWRSEVG

KQLRPLYEEYVVLKNEMARANHYEDYGDYWRGDYEVNGVDGYDYS

RGQLIEDVEHTFEEIKPLYEHLHAYVRAKLMNAYPSYISPIGCLP

AHLLGDMWGRFWTNLYSLTVPFGQKPNIDVTDAMVDQAWDAQRIF

KEAEKFFVSVGLPNMTQGFWENSMLTDPGNVQKAVCHPTAWDLGK

GDFRILMCTKVTMDDFLTAHHEMGHIQYDMAYAAQPFLLRNGANE

GFHEAVGEIMSLSAATPKHLKSIGLLSPDFQEDNETEINFLLKQA

LTIVGTLPFTYMLEKWRWMVFKGEIPKDQWMKKWWEMKREIVGVV

EPVPHDETYCDPASLFHVSNDYSFIRYYTRTLYQFQFQEALCQAA

KHEGPLHKCDISNSTEAGQKLFNMLRLGKSEPWTLALENVVGAKN

MNVRPLLNYFEPLFTWLKDQNKNSFVGWSTDWSPYADEPKSSDKT

HTCPPCPAPELLGGPSVFLFPPKPKDTLMISRTPEVTCVVVDVSH

-continued

EDPEVKFNWYVDGVEVHNAKTKPREEQYNSTYRVVSVLTVLHQDW

LNGKEYKCKVSNKALPAPIEKTISKAKGQPREPQVYTLPPSRDEL

TKNQVSLTCLVKGFYPSDIAVEWESNGQPENNYKTTPPVLDSDGS

FFLYSKLTVDKSRWQQGNVFSCSVMHEALHNHYTQKSLSLSPGK (ACE2-Ig mutein with a CD5 signal peptide, and
an IgA1 upper hinge fused to an IgG1 hinge)

SEQ ID NO: 31

MPMGSLQPLATLYLLGMLVASVLAQSTIEEQAKTFLDKFNHEAED

LEYQSSLASWNYNTNITEENVQNMNNAGDKWSAFLKEQSTLAQMY

PLQEIQNLTVKLQLQALQQNGSSVLSEDKSKRLNTILNTMSTIYS

TGKVCNPDNPQECLLLEPGLNEIMANSLDYNERLWAWESWRSEVG

KQLRPLYEEYVVLKNEMARANHYEDYGDYWRGDYEVNGVDGYDYS

RGQLIEDVEHTFEEIKPLYEHLHAYVRAKLMNAYPSYISPIGCLP

AHLLGDMWGRFWTNLYSLTVPFGQKPNIDVTDAMVDQAWDAQRIF

KEAEKFFVSVGLPNMTQGFWENSMLTDPGNVQKAVCHPTAWDLGK

GDFRILMCTKVTMDDFLTAHHEMGHIQYDMAYAAQPFLLRNGANE

GFHEAVGEIMSLSAATPKHLKSIGLLSPDFQEDNETEINFLLKQA

LTIVGTLPFTYMLEKWRWMVFKGEIPKDQWMKKWWEMKREIVGVV

EPVPHDETYCDPASLFHVSNDYSFIRYYTRTLYQFQFQEALCQAA

KHEGPLHKCDISNSTEAGQKLFNMLRLGKSEPWTLALENVVGAKN

MNVRPLLNYFEPLFTWLKDQNKNSFVGWSTDWSPSTPPTPSPSTP

PTPSPSDKTHTCPPCPAPELLGGPSVFLFPPKPKDTLMISRTPEV

TCVVVDVSHEDPEVKFNWYVDGVEVHNAKTKPREEQYNSTYRVVS

VLTVLHQDWLNGKEYKCKVSNKALPAPIEKTISKAKGQPREPQVY

TLPPSRDELTKNQVSLTCLVKGFYPSDIAVEWESNGQPENNYKTT

PPVLDSDGSFFLYSKLTVDKSRWQQGNVFSCSVMHEALHNHYTQK

SLSLSPGK (ACE2-Ig mutein with a CD5 signal peptide, a
collectrin domain, and an IgA1 upper
hinge fused. to an IgG2
hinge overlapping at CC)

SEQ ID NO: 32

MPMGSLQPLATLYLLGMLVASVLAQSTIEEQAKTFLDKFNHEAED

LFYQSSLASWNYNTNITEENVQNMNNAGDKWSAFLKEQSTLAQMY

PLQEIQNLTVKLQLQALQQNGSSVLSEDKSKRLNTILNTMSTIYS

TGKVCNPDNPQECLLLEPGLNEIMANSLDYNERLWAWESWRSEVG

KQLRPLYEEYVVLKNEMARANHYEDYGDYWRGDYEVNGVDGYDYS

RGQLIEDVEHTFEEIKPLYEHLHAYVRAKLMNAYPSYISPIGCLP

AHLLGDMWGRFWTNLYSLTVPFGQKPNIDVTDAMVDQAWDAQRIF

KEAEKFFVSVGLPNMTQGFWENSMLTDPGNVQKAVCHPTAWDLGK

GDFRILMCTKVTMDDFLTAHHEMGNIQYDMAYAAQPFLLRNGANE

GFHEAVGEIMSLSAATPKHLKSIGLLSPDFQEDNETEINFLLKQA

LTIVGTLPFTYMLEKWRWMVFKGEIPKDQWMKKWWEMKREIVGVV

EPVPHDETYCDPASLFHVSNDYSFIRYYTRTLYQFQFQEALCQAA

KHEGPLHKCDISNSTEAGQKLFNMLRLGKSEPWTLALENVVGAKN

-continued

```
MNVRPLLNYFEPLFTWLKDQNKNSFVGWSTDWSPYADQSIKVRIS

LKSALGDKAYEWNDNEMYLFRSSVAYAMRQYFLKVKNQMILFGEE

DVRVANLKPRISFNFFVTAPKNVSDIIPRTEVEKAIRMSRSRIND

AFRLNDNSLEFLGIQPTLGPPNQPPVSTPPTPSPSCCVECPPCPA

PPVAGPSVFLFPPKPKDTLMISRTPEVTCVVVDVSHEDPEVQFNW

YVDGVEVHNAKTKPREEQFNSTFRVVSVLTVVHQDWLNGKEYKCK

VSNKGLPAPIEKTiSKTKGQPREPQVYTLPPSREEMTKNQVSLTC

LVKGFYPSDISVEWESNGQPENNYKTTPPMLDSDGSFFLYSKLTV

DKSRWQQGNVFSCSVLHEALHSHYTQKSLSLSPGK
```

(ACE2-Ig mutein with a CD5 signal peptide, a
collectin domain, and an IgA1 upper
hinge fused to an IgG2
hinge)

SEQ ID NO: 33

```
MPMGSLQPLATLYLLGMLVASVLAQSTIEEQAKTFLDKFNHEAED

LFYQSSLASWNYNTNITEENVQNMNNAGDKWSAFLKEQSTLAQMY

PLQEIQNLTVKLQLQALQQNGSSVLSEDKSKRLNTILNTMSTIYS

TGKVCNPDNPQECLLLEPGLNEIMANSLDYNERLWAWESWRSEVG

KQLRPLYEEYVVLKNEMARANHYEDYGDYWRGDYEVNGVDGYDYS

RGQLIEDVEHTFEEIKPLYEHLHAYVRAKLMNAYPSYISPIGCLP

AHLLGDMWGRFWTNLYSLTVPFGQKPNIDVTDAMVDQAWDAQRIF

KEAEKFFVSVGLPNMTQGFWENSMLTDPGNVQKAVCHPTAWDLGK

GDFRILMCTKVTMDDFLTAHHEMGNIQYDMAYAAQPFLLRNGANE

GFHEAVGEIMSLSAATPKHLKSIGLLSPDFQEDNETEINFLLKQA

LTIVGTLPFTYMLEKWRWMVFKGEIPKDQWMKKWWEMKREIVGVV

EPVPHDETYCDPASLFHVSNDYSFIRYYTRTLYQFQFQEALCQAA

KHEGPLHKCDISNSTEAGQKLFNMLRLGKSEPWTLALENVVGAKN

MNVRPLLNYFEPLFTWLKDQNKNSFVGWSTDWSPYADQSIKVRIS

LKSALGDKAYEWNDNEMYLFRSSVAYAMRQYFLKVKNQMILFGEE

DVRVANLKPRISFNFFVTAPKNVSDIIPRTEVEKAIRMSRSRIND

AFRLNDNSLEFLGIQPTLGPPNQPPVSTPPTPSPSCPPCPAPPVA

GPSVFLFPPKPKDTLMISRTPEVTCVVVDVSHEDPEVQFNWYVDG

VEVHNAKTKPREEQFNSTFRVVSVLTVVHQDWLNGKEYKCKVSNK

GLPAPIEKTISKTKGQPREPQVYTLPPSREEMTKNQVSLTCLVKG

FYPSDISVEWESNGQPENNYKTTPPMLDSDGSFFLYSKLTVDKSR

WQQGNVFSCSVLHEALHSHYTQKSLSLSPGK
```

(ACE2-Ig mutein with a CD5 signal peptide, a
collectin domain containing A714C, and
an IgA1 upper hinge
fused to an IgG2 hinge overlapping at CC)

SEQ ID NO: 34

```
MPMGSLQPLATLYLLGMLVASVLAQSTIEEQAKTFLDKFNHEAED

LFYQSSLASWNYNTNITEENVQNMNNAGDKWSAFLKEQSTLAQMY

PLQETQNLTVKLQLQALQQNGSSVLSEDKSKRLNTILNTMSTIYS

TGKVCNPDNPQECLLLEPGLNEIMANSLDYNERLWAWESWRSEVG
```

-continued

```
KQLRPLYEEYVVLKNEMARANHYEDYGDYWRGDYEVNGVDGYDYS

RGQLIEDVEHTFEEIKPLYEHLHAYVRAKLMNAYPSYISPIGCLP

AHLLGDMWGRFWTNLYSLTVPFGQKPNIDVTDAMVDQAWDAQRIF

KEAEKFFVSVGLPNMTQGFWENSMLTDPGNVQKAVCHPTAWDLGK

GDFRILMCTKVTMDDFLTAHHEMGNIQYDMAYAAQPFLLRNGANE

GFHEAVGEIMSLSAATPKHLKSIGLLSPDFQEDNETEINFLLKQA

LT1VGTLPFTYMLEKWRWMVFKGEIPKDQWMKKWWEMKREIVGVV

EPVPHDETYCDPASLFHVSNDYSFIRYYTRTLYQFQFQEALCQAA

KHEGPLHKCDISNSTEAGQKLFNMLRLGKSEPWTLALENVVGAKN

MNVRPLLNYFEPLFTWLKDQNKNSFVGWSTDWSPYADQSIKVRIS

LKSALGDKAYEWNDNEMYLFRSSVAYAMRQYFLKVKNQMILFGEE

DVRVANLKPRISFNFFVTAPKNVSDIIPRTEVEKAIRMSRSRIND

CFRLNDNSLEFLGIQPTLGPPNQPPVSTPPTPSPSCVECPPCPA

PPVAGPSVFLFPPKPKDTLMISRTPEVTCVVVDVSHEDPEVQFNW

YVDGVEVHNAKTKPREEQFNSTFRVVSVLTVVHQDWLNGKEYKCK

VSNKGLPAPIEKTISKTKGQPREPQVYTLPPSREEMTKNQVSLTC

LVKGFYPSDISVEWESNGQPENNYKTTPPMLDSDGSFFLYSKLTV

DKSRWQQGNVFSCSVLHEALHSHYTQKSLSLSPGK
```

(ACE2-Ig mutein with a CD5 signal peptide, a
collectin domain containing A714C, and
an IgA1 upper hinge
fused to an IgG2 hinge)

SEQ ID NO: 35

```
MPMGSLQPLATLYLLGMLVASVLAQSTIEEQAKTFLDKFNHEAED

LFYQSSLASWNYNTNITEENVQNMNNAGDKWSAFLKEQSTLAQMY

PLQEIQNLTVKLQLQALQQNGSSVLSEDKSKRLNTILNTMSTIYS

TGKVCNPDNPQECLLLEPGLNEIMANSLDYNERLWAWESWRSEVG

KQLRPLYEEYVVLKNEMARANHYEDYGDYWRGDYEVNGVDGYDYS

RGQLIEDVEHTFEEIKPLYEHLHAYVRAKLMNAYPSYISPIGCLP

AHLLGDMWGRFWTNLYSLTVPFGQKPNIDVTDAMVDQAWDAQRIF

KEAEKFFVSVGLPNMTQGFWENSMLTDPGNVQKAVCHPTAWDLGK

GDFRILMCTKVTMDDFLTAHHEMGNIQYDMAYAAQPFLLRNGANE

GFHEAVGEIMSLSAATPKHLKSIGLLSPDFQEDNETEINFLLKQA

LTIVGTLPFTYMLEKWRWMVFKGEIPKDQWMKKWWEMKREIVGVV

EPVPHDETYCDPASLFHVSNDYSFIRYYTRTLYQFQFQEALCQAA

KHEGPLHKCDISNSTEAGQKLFNMLRLGKSEPWTLALENVVGAKN

MNVRPLLNYFEPLFTWLKDQNKNSFVGWSTDWSPYADQSIKVRIS

LKSALGDKAYEWNDNEMYLFRSSVAYAMRQYFLKVKNQMILFGEE

DVRVANLKPRISFNFFVTAPKNVSDTIPRTEVEKAIRMSRSRIND

CFRLNDNSLEFLGIQPTLGPPNQPPVSTPPTPSPSCPPCPAPPVA

GPSVFLFPPKPKDTLMISRTPEVTCVVVDVSHEDPEVQFNWYVDG

VEVHNAKTKPREEQFNSTFRVVSVLTVVHQDWLNGKEYKCKVSNK

GLPAPIEKTISKTKGQPREPQVYTLPPSREEMTKNQVSLTCLVKG
```

-continued

FYPSDISVEWESNGQPENNYKTTPPMLDSDGSFFLYSKLTVDKSR

WQQGNVFSCSVLHEALHSHYTQKSLSLSPGK (ACE2-Ig mutein with a CD5 signal peptide,
A25V/A342V, a collectrin domain, and
an IgA1 upper hinge fused
to an IgG2 hinge overlapping at CC)
                                    SEQ ID NO: 36
MPMGSLQPLATLYLLGMLVASVLAQSTIEEQVKTFLDKFNHEAED

LFYQSSLASWNYNTNITEENVQNMNNAGDKWSAFLKEQSTLAQMY

PLQEIQNLTVKLQLQALQQNGSSVLSEDKSKRLNTILNTMSTIYS

TGKVCNPDNPQECLLLEPGLNEIMANSLDYNERLWAWESWRSEVG

KQLRPLYEEYVVLKNEMARANHYEDYGDYWRGDYEVNGVDGYDYS

RGQLIEDVEHTFEEIKPLYEHLHAYVRAKLMNAYPSYISPIGCLP

AHLLGDMWGRFWTNLYSLTVPFGQKPNIDVTDAMVDQAWDAQRIF

KEAEKFFVSVGLPNMTQGFWENSMLTDPGNVQKVVCHPTAWDLGK

GDFRILMCTKVTMDDFLTAHHEMGNIQYDMAYAAQPFLLRNGANE

GFHEAVGEIMSLSAATPKHLKSIGLLSPDFQEDNETEINFLLKQA

LTIVGTLPFTYMLEKWRWMVFKGEIPKDQWMKKWWEMKREIVGVV

EPVPHDETYCDPASLFHVSNDYSFIRYYTRTLYQFQFQEALCQAA

KHEGPLHKCDISNSTEAGQKLFNMLRLGKSEPWTLALENVVGAKN

MNVRPLLNYFEPLFTWLKDQNKNSFVGWSTDWSPYADQSIKVRIS

LKSALGDKAYEWNDNEMYLFRSSVAYAMRQYFLKVKNQMILFGEE

DVRVANLKPRTSFNFFVTAPKNVSDITPRTEVEKATRMSRSRTND

AFRLNDNSLEFLGTQPTLGPPNQPPVSTPPTPSPSCCVECPPCPA

PPVAGPSVFLFPPPKPKDTLMISRTPEVTCVVVDVSHEDPEVQFNW

YVDGVEVHNAKTKPREEQFNSTFRVVSVLTVVHQDWLNGKEYKCK

VSNKGLPAPIEKTISKTKGQPREPQVYTLPPSREEMTKNQVSLTC

LVKGFYPSDISVEWESNGQPENNYKTTPPMLDSDGSFFLYSKLTV

DKSRWQQGNVFSCSVLHEALHSHYTQKSLSLSPGK (ACE2-Ig mutein with a CD5 signal peptide,
A25V/A342V, a collectrin domain,
and an IgA1 upper hinge fused
to an IgG2 hinge)
                                    SEQ ID NO: 37
MPMGSLQPLATLYLLGMLVASVLAQSTIEEQVKTFLDKFNHEAED

LFYQSSLASWNYNTNITEENVQNMNNAGDKWSAFLKEQSTLAQMY

PLQEIQNLTVKLQLQALQQNGSSVLSEDKSKRLNTILNTMSTIYS

TGKVCNPDNPQECLLLEPGLNEIMANSLDYNERLWAWESWRSEVG

KQLRPLYEEYVVLKNEMARANHYEDYGDYWRGDYEVNGVDGYDYS

RGQLIEDVEHTFEEIKPLYEHLHAYVRAKLMNAYPSYISPIGCLP

AHLLGDMWGRFWTNLYSLTVPFGQKPNIDVTDAMVDQAWDAQRIF

KEAEKFFVSVGLPNMTQGFWENSMLTDPGNVQKVVCHPTAWDLGK

GDFRILMCTKVTMDDFLTAHHEMGNIQYDMAYAAQPFLLRNGANE

GFHEAVGEIMSLSAATPKHLKSIGLLSPDFQEDNETEINFLLKQA

LTIVGTLPFTYMLEKWRWMVFKGEIPKDQWMKKWWEMKREIVGVV

EPVPHDETYCDPASLFHVSNDYSFIRYYTRTLYQFQFQEALCQAA

-continued

KHEGPLHKCDISNSTEAGQKLFNMLRLGKSEPWTLALENVVGAKN

MNVRPLLNYFEPLFTWLKDQNKNSFVGWSTDWSPYADQSIKVRIS

LKSALGDKAYEWNDNEMYLFRSSVAYAMRQYFLKVKNQMILFGEE

DVRVANLKPRISFNFFVTAPKNVSDiIPRTEVEKAIRMSRSRIND

AFRLNDNSLEFLGIQPTLGPPNQPPVSTPPTPSPSCPPCPAPPVA

GPSVFLFPPPKPKDTLMISRTPEVTCVVVDVSHEDPEVQFNWYVDG

VEVHNAKTKPREEQFNSTFRVVSVLTVVHQDWLNGKEYKCKVSNK

GLPAPIEKTISKTKGQPREPQVYTLPPSREEMTKNQVSLTCLVKG

FYPSDISVEWESNGQPENNYKTTPPMLDSDGSFFLYSKLTVDKSR

WQQGNVFSCSVLHEALHSHYTQKSLSLSPGK (ACE2-Ig mutein with a CDS signal peptide,
A25V/A342V, a collectrin domain
containing A714C, and an IgA1
upper hinge fused to an IgG2 hinge
overlapping at CC)
                                    SEQ ID NO: 38
MPMGSLQPLATLYLLGMLVASVLAQSTIEEQVKTFLDKFNHEAED

LFYQSSLASWNYNTNITEENVQNMNNAGDKWSAFLKEQSTLAQMY

PLQEIQNLTVKLQLQALQQNGSSVLSEDKSKRLNTILNTMSTIYS

TGKVCNPDNPQECLLLEPGLNEIMANSLDYNERLWAWESWRSEVG

KQLRPLYEEYVVLKNEMARANHYEDYGDYWRGDYEVNGVDGYDYS

RGQLIEDVEHTFEEIKPLYEHLHAYVRAKLMNAYPSYISPIGCLP

AHLLGDMWGREWTNLYSLTVPFGQKPNIDVTDAMVDQAWDAQRIF

KEAEKFFVSVGLPNMTQGFWENSMLTDPGNVQKVVCHPTAWDLGK

GDFRILMCTKVTMDDFLTAHHEMGNIQYDMAYAAQPFLLRNGANE

GFHEAVGEIMSLSAATPKHLKSIGLLSPDFQEDNETEINFLLKQA

LTIVGTLPFTYMLEKWRWMVFKGEIPKDQWMKKWWEMKREIVGVV

EPVPHDETYCDPASLFHVSNDYSFIRYYTRTLYQFQFQEALCQAA

KHEGPLHKCDISNSTEAGQKLFNMLRLGKSEPWTLALENVVGAKN

MNVRPLLNYFEPLFTWLKDQNKNSFVGWSTDWSPYADQSIKVRIS

LKSALGDKAYEWNDNEMYLFRSSVAYAMRQYFLKVKNQMILFGEE

DVRVANLKPRISFNFFVTAPKNVSDIIPRTEVEKAIRMSRSRIND

CFRLNDNSLEFLGIQPTLGPPNQPPVSTPPTPSPSCCVECPPCPA

PPVAGPSVFLFPPPKPKDTLMISRTPEVTCVVVDVSHEDPEVQFNW

YVDGVEVHNAKTKPREEQFNSTFRVVSVLTVVHQDWLNGKEYKCK

VSNKGLPAPIEKTISKTKGQPREPQVYTLPPSREEMTKNQVSLTC

LVKGFYPSDISVEWESNGQPENNYKTTPPMLDSDGSFFLYSKLTV

DKSRWQQGNVFSCSVLHEALHSHYTQKSLSLSPGK (ACE2-Ig mutein with a CD5 signal peptide, a
collectrin domain containing A714C,
A25V/A342V, and an IgA1
upper hinge fused to an lgG2 hinge)
                                    SEQ ID NO: 39
MPMGSLQPLATLYLLGMLVASVLAQSTIEEQVKTFLDKFNHEAED

LFYQSSLASWNYNTNITEENVQNMNNAGDKWSAFLKEQSTLAQMY

PLQEIQNLTVKLQLQALQQNGSSVLSEDKSKRLNTILNTMSTiYS

-continued

```
TGKVCNPDNPQECLLLEPGLNEIMANSLDYNERLWAWESWRSEVG

KQLRPLYEEYVVLKNEMARANHYEDYGDYWRGDYEVNGVDGYDYS

RGQLIEDVEHTFEEIKPLYEHLHAYVRAKLMNAYPSYISPIGCLP

AHLLGDMWGRFWTNLYSLTVPFGQKPNIDVTDAMVDQAWDAQRIF

KEAEKFFVSVGLPNMTQGFWENSMLTDPGNVQKVVCHPTAWDLGK

GDFRILMCTKVTMDDFLTAHHEMGNIQYDMAYAAQPFLLRNGANE

GFHEAVGEIMSLSAATPKHLKSIGLLSPDFQEDNETEINFLLKQA

LTIVGTLPFTYMLEKWRWMVFKGEIPKDQWMKKWWEMKREIVGVV

EPVPHDETYCDPASLFHVSNDYSFIRYYTRTLYQFQFQEALCQAA

KHEGPLHKCDISNSTEAGQKLFNMLRLGKSEPWTLALENVVGAKN

MNVRPLLNYFEPLFTWLKDQNKNSFVGWSTDWSPYADQSIKVRIS

LKSALGDKAYEWNDNEMYLFRSSVAYAMRQYFLKVKNQMILFGEE

DVRVANLKPRISFNFFVTAPKNVSDIIPRTEVEKAIRMSRSRIND

CFRLNDNSLEFLGIQPTLGPPNQPPVSTPPTPSPSCPPCPAPPVA

GPSVFLFPPKPKDTLMISRTPEVTCVVVDVSHEDPEVQFNWYVDG

VEVHNAKTKPREEQFNSTFRVVSVLTVVHQDWLNGKEYKCKVSNK

GLPAPIEKTISKTKGQPREPQVYTLPPSREEMTKNQVSLTCLVKG

FYPSDISVEWESNGQPENNYKTTPPMLDSDGSFFLYSKLTVDKSR

WQQGNVFSCSVLHEALHSHYTQKSLSLSPGK
```

(ACE2-Ig mutein with a CD5 signal peptide,
K74C/S106C, A25V/A342V, and an IgA1
upper hinge fused to an
IgG2 hinge)

SEQ ID NO: 40
```
MPMGSLQPLATLYLLGMLVASVLAQSTIEEQVKTFLDKFNHEAED

LFYQSSLASWNYNTNITEENVQNMNNAGDKWSAFLCEQSTLAQMY

PLQEIQNLTVKLQLQALQQNGSCVLSEDKSKRLNTILNTMSTIYS

TGKVCNPDNPQECLLLEPGLNEIMANSLDYNERLWAWESWRSEVG

KQLRPLYEEYVVLKNEMARANHYEDYGDYWRGDYEVNGVDGYDYS

RGQLIEDVEHTFEEIKPLYEHLHAYVRAKLMNAYPSYISPIGCLP

AHLLGDMWGRFWTNLYSLTVPFGQKPNIDVTDAMVDQAWDAQRIF

KEAEKFFVSVGLPNMTQGFWENSMLTDPGNVQKVVCHPTAWDLGK

GDFRILMCTKVTMDDFLTAHHEMGHIQYDMAYAAQPFLLRNGANE

GFHEAVGEIMSLSAATPKHLKSIGLLSPDFQEDNETEINFLLKQA

LTIVGTLPFTYMLEKWRWMVFKGEIPKDQWMKKWWEMKREIVGVV

EPVPHDETYCDPASLFHVSNDYSFIRYYTRTLYQFQFQEALCQAA

KHEGPLHKCDISNSTEAGQKLFNMLRLGKSEPWTLALENVVGAKN

MNVRPLLNYFEPLFTWLKDQNKNSFVGWSTDWSPYADQSPSTPPT

PSPSCCVECPPCPAPPVAGPSVFLFPPKPKDTLMISRTPEVTCVV

VDVSHEDPEVQFNWYVDGVEVHNAKTKPREEQFNSTFRVVSVLTV

VHQDWLNGKEYKCKVSNKGLPAPIEKTISKTKGQPREPQVYTLPP
```

-continued

```
SREEMTKNQVSLTCLVKGFYPSDISVEWESNGQPENNYKTTPPML

DSDGSFFLYSKLTVDKSRWQQGNVFSCSVLHEALHSHYTQKSLSL

SPGK
```

(ACE2-Ig mutein with a CDS signal peptide,
S128C/V343C/C344S/C361S, A25V/A342V,
and an IgA1 upper hinge
fused to an IgG2 hinge)

SEQ ID NO: 41
```
MPMGSLQPLATLYLLGMLVASVLAQSTIEEQVKTFLDKFNHEAED

LFYQSSLASWNYNTNITEENVQNMNNAGDKWSAFLKEQSTLAQMY

PLQEIQNLTVKLQLQALQQNGSSVLSEDKSKRLNTILNTMSTIYC

TGKVCNPDNPQECLLLEPGLNEIMANSLDYNERLWAWESWRSEVG

KQLRPLYEEYVVLKNEMARANHYEDYGDYWRGDYEVNGVDGYDYS

RGQLIEDVEHTFEEIKPLYEHLHAYVRAKLMNAYPSYISPIGCLP

AHLLGDMWGRFWTNLYSLTVPFGQKPNIDVTDAMVDQAWDAQRIF

KEAEKFFVSVGLPNMTQGFWENSMLTDPGNVQKVCSHPTAWDLGK

GDFRILMSTKVTMDDFLTAHHEMGHIQYDMAYAAQPFLLRNGANE

GFHEAVGEIMSLSAATPKHLKSIGLLSPDFQEDNETEINFLLKQA

LTIVGTLPFTYMLEKWRWMVFKGEIPKDQWMKKWWEMKREIVGVV

EPVPHDETYCDPASLFHVSNDYSFIRYYTRTLYQFQFQEALCQAA

KHEGPLHKCDISNSTEAGQKLFNMLRLGKSEPWTLALENVVGAKN

MNVRPLLNYFEPLFTWLKDQNKNSFVGWSTDWSPYADQSPSTPPT

PSPSCCVECPPCPAPPVAGPSVFLFPPKPKDTLMISRTPEVTCVV

VDVSHEDPEVQFNWYVDGVEVHNAKTKPREEQFNSTFRVVSVLTV

VHQDWLNGKEYKCKVSNKGLPAPIEKTISKTKGQPREPQVYTLPP

SREEMTKNQVSLTCLVKGFYPSDISVEWESNGQPENNYKTTPPML

DSDGSFFLYSKLTVDKSRWQQGNVFSCSVLHEALHSHYTQKSLSL

SPGK
```

(ACE2-Ig mutein with a CD5 signal peptide,
K74C/S106C/S128C/V343C/C344S/C361S,
A25V/A342V, and an IgA1
upper hinge fused to an lgG2 hinge)

SEQ ID NO: 42
```
MPMGSLQPLATLYLLGMLVASVLAQSTIEEQVKTFLDKFNHEAED

LFYQSSLASWNYNTNITEENVQNMNNAGDKWSAFLCEQSTLAQMY

PLQEIQNLTVKLQLQALQQNGSCVLSEDKSKRLNTILNTMSTIYC

TGKVCNPDNPQECLLLEPGLNEIMANSLDYNERLWAWESWRSEVG

KQLRPLYEEYVVLKNEMARANHYEDYGDYWRGDYEVNGVDGYDYS

RGQLIEDVEHTFEEIKPLYEHLHAYVRAKLMNAYPSYISPIGCLP

AHLLGDMWGRFWTNLYSLTVPFGQKPNIDVTDAMVDQAWDAQRIF

KEAEKFFVSVGLPNMTQGFWENSMLTDPGNVQKVCSHPTAWDLGK

GDFRILMSTKVTMDDFLTAHHEMGHIQYDMAYAAQPFLLRNGANE

GFHEAVGEIMSLSAATPKHLKSIGLLSPDFQEDNETEINFLLKQA

LTIVGTLPFTYMLEKWRWMVFKGEIPKDQWMKKWWEMKREIVGVV

EPVPHDETYCDPASLFHVSNDYSFIRYYTRTLYQFQFQEALCQAA
```

-continued

KHEGPLHKCDISNSTEAGQKLFNMLRLGKSEPWTLALENVVGAKN

MNVRPLLNYFEPLFTWLKDQNKNSFVGWSTDWSPYADQSPSTPPT

PSPSCCVECPPCPAPPVAGPSVFLFPPKPKDTLMISRTPEVTCVV

VDVSHEDPEVQFNWYVDGVEVHNAKTKPREEQFNSTFRVVSVLTV

VHQDWLNGKEYKCKVSNKGLPAPIEKTISKTKGQPREPQVYTLPP

SREEMTKNQVSLTCLVKGFYPSDISVEWESNGQPENNYKTTPPML

DSDGSFFLYSKLTVDKSRWQQGNVFSCSVLHEALHSHYTQKSLSL

SPGK (ACE2-Ig mutein with a CDS signal peptide,
K74C/S106C/S128C/V343/C344S/C345W/C361S,
A25V/A342V, and an
IgA1 upper hinge fused to an IgG2 hinge)

SEQ ID NO: 43

MPMGSLQPLATLYLLGMLVASVLAQSTIEEQVKTFLDKFNHEAED

LFYQSSLASWNYNTNITEENVQNMNNAGDKWSAFLCEQSTLAQMY

PLQEIQNLTVKLQLQALQQNGSCVLSEDKSKRLNTILNTMSTIYC

TGKVCNPDNPQECLLLEPGLNEIMANSLDYNERLWAWESWRSEVG

KQLRPLYEEYVVLKNEMARANHYEDYGDYWRGDYEVNGVDGYDYS

RGQLIEDVEHTFEEIKPLYEHLHAYVRAKLMNAYPSYISPIGCLR

AHLLGDMWGRFWTNLYSLTVPFGQKPNIDVTDAMVDQAWDAQRIF

KEAEKFFVSVGLPNMTQGFWENSMLTDPGNVQKVCSWPTAWDLGK

GDFRILMSTKVTMDDFLTAHHEMGHIQYDMAYAAQPFLLRNGANE

GFHEAVGEIMSLSAATPKHLKSIGLLSPDFQEDNETEINFLLKQA

LTIVGTLPFTYMLEKWRWMVFKGEIPKDQWMKKWWEMKREIVGVV

EPVPHDETYCDPASLFHVSNDYSFIRYYTRTLYQFQFQEALCQAA

KHEGPLHKCDISNSTEAGQKLFNMLRLGKSEPWTLALENVVGAKN

MNVRPLLNYFEPLFTWLKDQNKNSFVGWSTDWSPYADQSPSTPPT

PSPSCCVECPPCPAPPVAGPSVFLFPPKPKDTLMISRTPEVTCVV

VDVSHEDPEVQFNWYVDGVEVHNAKTKPREEQFNSTFRVVSVLTV

VHQDWLNGKEYKCKVSNKGLPAPIEKTISKTKGQPREPQVYTLPP

SREEMTKNQVSLTCLVKGFYPSDISVEWESNGQPENNYKTTPPML

DSDGSFFLYSKLTVDKSRWQQGNVFSCSVLHEALHSHYTQKSLSL

SPGK (ACE2-Ig mutein with a CD5 signal peptide,
K74C/S106C/S128C/V343C/C344S/
H345Y/C3618/F504W, A25V/A342V,
and an IgA1 upper hinge fused
to an IgG2 hinge)

SEQ ID NO: 44

MPMGSLQPLATLYLLGMLVASVLAQSTIEEQVKTFLDKFNHEAED

LFYQSSLASWNYNTNITEENVQNMNNAGDKWSAFLCEQSTLAQMY

PLQEIQNLTVKLQLQALQQNGSCVLSEDKSKRLNTILNTMSTIYC

TGKVCNPDNPQECLLLEPGLNEIMANSLDYNERLWAWESWRSEVG

KQLRPLYEEYVVLKNEMARANHYEDYGDYWRGDYEVNGVDGYDYS

RGQLIEDVEHTFEEIKPLYEHLHAYVRAKLMNAYPSYISPIGCLP

AHLLGDMWGRFWTNLYSLTVPFGQKPNIDVTDAMVDQAWDAQRIF

-continued

KEAEKFFVSVGLPNMTQGFWENSMLTDPGNVQKVCSYPTAWDLGK

GDFRILMSTKVTMDDFLTAHHEMGHIQYDMAYAAQPFLLRNGANE

GFHEAVGEIMSLSAATPKHLKSIGLLSPDFQEDNETEINFLLKQA

LTIVGTLPFTYMLEKWRWMVFKGEIPKDQWMKKWWEMKREIVGVV

EPVPHDETYCDPASLWHVSNDYSFIRYYTRTLYQFQFQEALCQAA

KHEGPLHKCDISNSTEAGQKLFNMLRLGKSEPWTLALENVVGAKN

MNVRPLLNYFEPLFTWLKDQNKNSFVGWSTDWSPYADQSPSTPPT

PSPSCCVECPPCPAPPVAGPSVFLFPPKPKDTLMISRTPEVTCVV

VDVSHEDPEVQFNWYVVDGVEVHNAKTKPREEQFNSTFRVVSVLTV

VHQDWLNGKEYKCKVSNKGLPAPIEKTISKTKGQPREPQVYTLPP

SREEMTKNQVSLTCLVKGFYPSDTSVEWESNGQPENNYKTTPPML

DSDGSFFLYSKLTVDKSRWQQGNVFSCSVLHEALHSHYTQKSLSL

SPGK (ACE2-Ig mutein with a CD5 signal peptide,
K74C/S106C/S128C/V343C/C344S/
H345W/C361S/F504W, A25V/A342V,
and an IgA1 upper hinge fused to
an IgG2 hinge)

SEQ ID NO: 45

MPMGSLQPLATLYLLGMLVASVLAQSTIEEQVKTFLDKFNHEAED

LFYQSSLASWNYNTNITEENVQNMNNAGDKWSAFLCEQSTLAQMY

PLQEIQNLTVKLQLQALQQNGSGVLSEDKSKRLNTILNTMSTIYC

TGKVCNPDNPQECLLLEPGLNEIMANSLDYNERLWAWESWRSEVG

KQLRPLYEEYVVLKNEMARANHYEDYGDYWRGDYEVNGVDGYDYS

RGQLIEDVEHTFEEIKPLYEHLHAYVRAKLMNAYPSYISPIGCLP

AHLLGDMWGRFWTNLYSLTVPFGQKPNIDVTDAMVDQAWDAQRIF

KEAEKFFVSVGLPNMTQGFWENSMLTDPGNVQKVCSWPTAWDLGK

GDFRILMSTKVTMDDFLTAHHEMGHIQYDMAYAAQPFLLRNGANE

GFHEAVGEIMSLSAATPKHLKSIGLLSPDFQEDNETEINFLLKQA

LT1VGTLPFTYMLEKWRWMVFKGEIPKDQWMKKWWEMKREIVGVV

EPVPHDETYCDPASLWHVSNDYSFIRYYTRTLYQFQFQEALCQAA

KHEGPLHKCDISNSTEAGQKLFNMLRLGKSEPWTLALENVVGAKN

MNVRPLLNYFEPLFTWLKDQNKNSFVGWSTDWSPYADQSPSTPPT

PSPSCCVECPPCPAPPVAGPSVFLFPPKPKDTLMISRTPEVTCVV

VDVSHEDPEVQFNWYVDGVEVHNAKTKPREEQFNSTFRVVSVLTV

VHQDWLNGKEYKCKVSNKGLPAPIEKTISKTKGQPREPQVYTLPP

SREEMTKNQVSLTCLVKGFYPSDISVEWESNGQPENNYKTTPPML

DSDGSFFLYSKLTVDKSRWQQGNVFSCSVLHEALHSHYTQKSLSL

SPGK (ACE2-Ig mutein with a CD5 signal peptide,
K74C/S106C, A25V/A342V, I259S,
C261S, F603G, a collectrin
domain, and an IgA1 upper hinge
fused to an IgG2 hinge)

SEQ ID NO: 46

MPMGSLQPLATLYLLGMLVASVLAQSTIEEQVKTFLDKFNHEAED

LEYQSSLASWNYNTNITEENVQNMNNAGDKWSAFLCEQSTLAQMY

-continued                                          -continued

PLQEIQNLTVKLQLQALQQNGSCVLSEDKSKRLNTILNTMSTIYS

TGKVCNPDNPQECLLLEPGLNEIMANSLDYNERLWAWESWRSEVG

KQLRPLYEEYVVLKNEMARANHYEDYGDYWRGDYEVNGVDGYDYS

RGQLIEDVEHTFEEIKPLYEHLHAYVRAKLMNAYPSYISPSGSLP

AHLLGDMWGRFWTNLYSLTVPFGQKPNIDVTDAMVDQAWDAQRIF

KEAEKFFVSVGLPNMTQGFWENSMLTDPGNVQKVVCHPTAWDLGK

GDFRILMCTKVTMDDFLTAHHEMGHIQYDMAYAAQPFLLRNGANE

GFHEAVGEIMSLSAATPKHLKSIGLLSPDFQEDNETEINFLLKQA

LTIVGTLPFTYMLEKWRWMVFKGEIPKDQWMKKWWEMKREIVGVV

EPVPHDETYCDPASLFHVSNDYSFIRYYTRTLYQFQFQEALCQAA

KHEGPLHKCDISNSTEAGQKLFNMLRLGKSEPWTLALENVVGAKN

MNVRPLLNYFEPLFTWLKDQNKNSGVGWSTDWSPYADQSTKVRIS

LKSALGDKAYEWNDNEMYLFRSSVAYAMRQYFLKVKNQMILFGEE

DVRVANLKPRISFNFFVTAPKNVSDIIPRTEVEKAIRMSRSRIND

AFRLNDNSLEFLGIQPTLGPPNQPPVSTPPTPSPSCPPCPAPPVA

GPSVFLFPPKPKDTLMISRTPEVTCVVVDVSHEDPEVQFNWYVDG

VEVHNAKTKPREEQFNSTFRVVSVLTVVHQDWLNGKEYKCKVSNK

GLPAPIEKTISKTKGQPREPQVYTLPPSREEMTKNQVSLTCLVKG

FYPSDISVEWESNGQPENNYKTTPPMLDSDGSFFLYSKLTVDKSR

WQQGNVFSCSVLHEALHSHYTQKSLSLSPGK (ACE2-Ig mutein with a CDS signal peptide,
S128C/V343C/C344S/C361S, A25V/A342V,
I259S, C261S, F603G, a
collectin domain, and an IgA1 upper
hinge fused to an IgG2
hinge)
                                        SEQ ID NO: 47
MPMGSLQPLATLYLLGMLVASVLAQSTIEEQVKTFLDKFNHEAED

LFYQSSLASWNYNTNITEENVQNMNNAGDKWSAFLKEQSTLAQMY

PLQEIQNLTVKLQLQALQQNGSSVLSEDKSKRLNTILNTMSTlYC

TGKVCNPDNPQECLLLEPGLNEIMANSLDYNERLWAWESWRSEVG

KQLRPLYEEYVVLKNEMARANHYEDYGDYWRGDYEVNGVDGYDYS

RGQLIEDVEHTFEEIKPLYEHLHAYVRAKLMNAYPSYISPSGSLP

AHLLGDMWGRFWTNLYSLTVPFGQKPNIDVTDAMVDQAWDAQRIF

KEAEKFFVSVGLPNMTQGFWENSMLTDPGNVQKVCSHPTAWDLGK

GDFRILMSTKVTMDDFLTAHHEMGHIQYDMAYAAQPFLLRNGANE

GFHEAVGEIMSLSAATPKHLKSIGLLSPDFQEDNETEINFLLKQA

LTIVGTLPFTYMLEKWRWMVFKGEIPKDQWMKKWWEMKREIVGVV

EPVPHDETYCDPASLFHVSNDYSFIRYYTRTLYQFQFQEALCQAA

KHEGPLHKCDISNSTEAGQKLFNMLRLGKSEPWTLALENVVGAKN

MNVRPLLNYFEPLFTWLKDQNKNSGVGWSTDWSPYADQSIKVRIS

LKSALGDKAYEWNDNEMYLFRSSVAYAMRQYFLKVKNQMILFGEE

DVRVANLKPRISFNFFVTAPKNVSDIIPRTEVEKAIRMSRSRIND

AFRLNDNSLEFLGIQPTLGPPNQPPVSTPPTPSPSCPPCPAPPVA

GPSVFLFPPKPKDTLMISRTPEVTCVVVDVSHEDPEVQFNWYVDG

VEVHNAKTKPREEQFNSTFRVVSVLTVVHQDWLNGKEYKCKVSNK

GLPAPIEKTISKTKGQPREPQVYTLPPSREEMTKNQVSLTCLVKG

FYPSDISVEWESNGQPENNYKTTPPMLDSDGSFFLYSKLTVDKSR

WQQGNVFSCSVLHEALHSHYTQKSLSLSPGK (ACE2-Ig mutein with a CD5 signal peptide,
K74C/S106C/S128C/V343C/C344S/C361S,
A25V/A342V, I259S, C261S,
F603G, a collectin domain, and an
IgA1 upper hinge fused to
an IgG2 hinge)
                                        SEQ ID NO: 48
MPMGSLQPLATLYLLGMLVASVLAQSTIEEQVKTFLDKFNHEAED

LFYQSSLASWNYNTNITEENVQNMNNAGDKWSAFLCEQSTLAQMY

PLQEIQNLTVKLQLQALQQNGSCVLSEDKSKRLNTILNTMSTiYC

TGKVCNPDNPQECLLLEPGLNEIMANSLDYNERLWAWESWRSEVG

KQLRPLYEEYVVLKNEMARANHYEDYGDYWRGDYEVNGVDGYDYS

RGQLIEDVEHTFEEIKPLYEHLHAYVRAKLMNAYPSYISPSGSLP

AHLLGDMWGRFWTNLYSLTVPFGQKPNIDVTDAMVDQAWDAQRIF

KEAEKFFVSVGLPNMTQGFWENSMLTDPGNVQKVCSHPTAWDLGK

GDFRILMSTKVTMDDFLTAHHEMGHIQYDMAYAAQPFLLRNGANE

GFHEAVGEIMSLSAATPKHLKSIGLLSPDFQEDNETEINFLLKQA

LTIVGTLPFTYMLEKWRWMVFKGEIPKDQWMKKWWEMKREIVGVV

EPVPHDETYCDPASLFHVSNDYSFIRYYTRTLYQFQFQEALCQAA

KHEGPLHKCDISNSTEAGQKLFNMLRLGKSEPWTLALENVVGAKN

MNVRPLLNYFEPLFTWLKDQNKNSGVGWSTDWSPYADQSIKVRIS

LKSALGDKAYEWNDNEMYLFRSSVAYAMRQYFLKVKNQMILFGEE

DVRVANLKPRISFNFFVTAPKNVSDIIPRTEVEKAIRMSRSRIND

AFRLNDNSLEFLGIQPTLGPPNQPPVSTPPTPSPSCPPCPAPPVA

GPSVFLFPPKPKDTLMISRTPEVTCVVVDVSHEDPEVQFNWYVDG

VEVHNAKTKPREEQFNSTFRVVSVLTVVHQDWLNGKEYKCKVSNK

GLPAPIEKTISKTKGQPREPQVYTLPPSREEMTKNQVSLTCLVKG

FYPSDISVEWESNGQPENNYKTTPPMLDSDGSFFLYSKLTVDKSR

WQQGNVFSCSVLHEALHSHYTQKSLSLSPGK (ACE2-Ig mutein with a CD5 signal peptide,
K74C/S106C/S128C/V343C/C344S/H345W/C361S,
A25V/A342V, I259S,
C261S, F603G, a collectin domain,
and an IgA1 upper hinge
fused to an IgG2 hinge)
                                        SEQ ID NO: 49
MPMGSLQPLATLYLLGMLVASVLAQSTIEEQVKTFLDKFNHEAED

LFYQSSLASWNYNTNITEENVQNMNNAGDKWSAFLCEQSTLAQMY

PLQEIQNLTVKLQLQALQQNGSCVLSEDKSKRLNTILNTMSTIYC

TGKVCNPDNPQECLLLEPGLNEIMANSLDYNERLWAWESWRSEVG

KQLRPLYEEYVVLKNEMARANHYEDYGDYWRGDYEVNGVDGYDYS

RGQLIEDVEHTFEEIKPLYEHLHAYVRAKLMNAYPSYTSPSGSLP

-continued

AHLLGDMWGRFWTNLYSLTVPFGQKPNIDVTDAMVDQAWDAQRIF

KEAEKFFVSVGLPNMTQGFWENSMLTDPGNVQKVCSWPTAWDLGK

GDFRILMSTKVTMDDFLTAHHEMGHIQYDMAYAAQPFLLRNGANE

GFHEAVGEIMSLSAATPKHLKSIGLLSPDFQEDNETEINFLLKQA

LTIVGTLPFTYMLEKWRWMVFKGEIPKDQWMKKWWEMKREIVGVV

EPVPHDETYCDPASLFHVSNDYSFIRYYTRTLYQFQFQEALCQAA

KHEGPLHKCDISNSTEAGQKLFNMLRLGKSEPWTLALENVVGAKN

MNVRPLLNYFEPLFTWLKDQNKNSGVGWSTDWSPYADQSTKVRTS

LKSALGDKAYEWNDNEMYLFRSSVAYAMRQYFLKVKNQMILFGEE

DVRVANLKPRISFNFFVTAPKNVSDIIPRTEVEKAIRMSRSRIND

AFRLNDNSLEFLGIQPTLGPPNQPPVSTPPTPSPSCPPCPAPPVA

GPSVFLFPPKPKDTLMISRTPEVTCVVVDVSHEDPEVQFNWYVDG

VEVHNAKTKPREEQFNSTFRVVSVLTVVHQDWLNGKEYKCKVSNK

GLPAPIEKTISKTKGQPREPQVYTLPPSREEMTKNQVSLTCLVKG

FYPSDISVEWESNGQPENNYKTTPPMLDSDGSFFLYSKLTVDKSR

WQQGNVFSCSVLHEALHSHYTQKSLSLSPGK (ACE2-Ig mutein with a CD5 signal peptide,
K74C/S106C/S128C/V343C/C344S/C361S,
A25V/A342V, H345W/F504W,
I259S, C261S, F603G, a collectrin domain,
and an IgA1 upper
hinge fused to an IgG2 hinge)
SEQ ID NO: 50

MPMGSLQPLATLYLLGMLVASVLAQSTIEEQVKTFLDKFNHEAED

LFYQSSLASWNYNTNITEENVQNMNNAGDKWSAFLCEQSTLAQMY

PLQEIQNLTVKLQLQALQQNGSCVLSEDKSKRLNTILNTMSTIYC

TGKVCNPDNPQECLLLEPGLNEIMANSLDYNERLWAWESWRSEVG

KQLRPLYEEYVVLKNEMARANHYEDYGDYWRGDYEVNGVDGYDYS

RGQLIEDVEHTFEEIKPLYEHLHAYVRAKLMNAYPSYISPSGSLP

AHLLGDMWGRFWTNLYSLTVPFGQKPNIDVTDAMVDQAWDAQRIF

KEAEKFFVSVGLPNMTQGFWENSMLTDPGNVQKVCSWPTAWDLGK

GDFRILMSTKVTMDDFLTAHHEMGHIQYDMAYAAQPFLLRNGANE

GFHEAVGEIMSLSAATPKHLKSIGLLSPDFQEDNETEINFLLKQA

LTIVGTLPFTYMLEKWRWMVFKGEIPKDQWMKKWWEMKREIVGVV

EPVPHDETYCDPASLWHVSNDYSFIRYYTRTLYQFQFQEALCQAA

KHEGPLHKCDISNSTEAGQKLFNMLRLGKSEPWTLALENVVGAKN

MNVRPLLNYFEPLFTWLKDQNKNSGVGWSTDWSPYADQSIKVRIS

LKSALGDKAYEWNDNEMYLFRSSVAYAMRQYFLKVKNQMILFGEE

DVRVANLKPRISFNFFVTAPKNVSDIIPRTEVEKAIRMSRSRIND

AFRLNDNSLEFLGIQPTLGPPNQPPVSTPPTPSPSCPPCPAPPVA

GPSVFLFPPKPKDTLMISRTPEVTCVVVDVSHEDPEVQFNWYVDG

VEVHNAKTKPREEQFNSTFRVVSVLTVVHQDWLNGKEYKCKVSNK

GLPAPIEKTISKTKGQPREPQVYTLPPSREEMTKNQVSLTCLVKG

-continued

EYPSDISVEWESNGQPENNYKTTPPMLDSDGSFFLYSKLTVDKSR

WQQGNVFSCSVLHEALHSHYTQKSLSLSPGK (ACE2-Ig mutein with an SAA1 signal peptide,
K74C/S106C/S128C/V343C/C344S/C3618,
A25V/A342V, H345W/F504W,
I259S, C261S, F603G, a collectrin
domain, and an IgA1 upper
hinge fused to an IgG2 hinge)
SEQ ID NO: 51

MALSWVLTVLSLLPLLEAQSTIEEQVKTFLDKFNHEAEDLFYQSS

LASWNYNTNITEENVQNMNNAGDKWSAFLCEQSTLAQMYPLQEIQ

NLTVKLQLQALQQNGSCVLSEDKSKRLNTILNTMSTIYCTGKVCN

PDNPQECLLLEPGLNEIMANSLDYNERLWAWESWRSEVGKQLRPL

YEEYVVLKNEMARANHYEDYGDYWRGDYEVNGVDGYDYSRGQLIE

DVEHTFEEIKPLYEHLHAYVRAKLMNAYPSYISPSGSLPAHLLGD

MWGRFWTNLYSLTVPFGQKPNIDVTDAMVDQAWDAQRIFKEAEKF

FVSVGLPNMTQGFWENSMLTDPGNVQKVCSWPTAWDLGKGDFRIL

MSTKVTMDDFLTAHHEMGHIQYDMAYAAQPFLLRNGANEGFHEAV

GEIMSLSAATPKHLKSIGLLSPDFQEDNETEINFLLKQALTIVGT

LPFTYMLEKWRWMVFKGEIPKDQWMKKWWEMKREIVGVVEPVPHD

ETYCDPASLWHVSNDYSFIRYYTRTLYQFQFQEALCQAAKHEGPL

HKCDISNSTEAGQKLFNMLRLGKSEPWTLALENVVGAKNMNVRPL

LNYFEPLFTWLKDQNKNSGVGWSTDWSPYADQSIKVRISLKSALG

DKAYEWNDNEMYLFRSSVAYAMRQYFLKVKNQMILFGEEDVRVAN

LKPRISFNFFVTAPKNV3DIIPRTEVEKAIPMSRSRIKDAFRLND

NSLEFLGIQPTLGPPNQPPVSTPPTPSPSCPPCPAPPVAGPSVFL

FPPKPKDTLMISRTPEVTCVVVDVSHEDPEVQFNWYVDGVEVHNA

KTKPREEQFNSTFRVVSVLTVVHQDWLNGKEYKCKVSNKGLPAPI

EKTISKTKGQPREPQVYTLPPSREEMTKNQVSLTCLVKGFYPSDI

SVEWESNGQPENNYKTTPPMLDSDGSFFLYSKLTVDKSRWQQGNV

FSCSVLHEALHSHYTQKSLSLSPGK (ACE2-Ig mutein with an SAA1 signal peptide,
K74C/S106C/S128C/V343C/C344S/C361S,
A25V/A342V, H345W/F504W,
I259S, C261S, F603G, a collectrin
domain with A714C, and an
IgA1 upper hinge fused to an IgG2 hinge)
SEQ ID NO: 52

MALSWVLTVLSLLPLLEAQSTIEEQVKTFLDKFNHEAEDLFYQSS

LASWNYNTNITEENVQNMNNAGDKWSAFLCEQSTLAQMYPLQEIQ

NLTVKLQLQALQQNGSCVLSEDKSKRLNTILNTMSTIYCTGKVCN

PDNPQECLLLEPGLNEIMANSLDYNERLWAWESWRSEVGKQLRPL

YEEYVVLKNEMARANHYEDYGDYWRGDYEVNGVDGYDYSRGQLIE

DVEHTFEEIKPLYEHLHAYVRAKLMNAYPSYISPSGSLPAHLLGD

MWGRFWTNLYSLTVPFGQKPNIDVTDAMVDQAWDAQRIFKEAEKF

FVSVGLPNMTQGFWENSMLTDPGNVQKVCSWPTAWDLGKGDFRIL

MSTKVTMDDFLTAHHEMGHIQYDMAYAAQPFLLRNGANEGFHEAV

-continued

-continued

GEIMSLSAATPKHLKSIGLLSPDFQEDNETEINFLLKQALTIVGT

LPFTYMLEKWRWMVFKGEIPKDQWMKKWWEMKREIVGVVEPVPHD

ETYCDPASLWHVSNDYSFIRYYTRTLYQFQFQEALCQAAKHEGPL

HKCDISNSTEAGQKLFNMLRLGKSEPWTLALENVVGAKNMNVRPL

LNYFEPLFTWLKDQNKNSGVGWSTDWSPYADQSIKVRISLKSALG

DKAYEWNDNEMYLFRSSVAYAMRQYFLKVKNQMILFGEEDVRVAN

LKPRISFNFFVTAPKNVSDIIPRTEVEKAIRMSRSRINDCFRLND

NSLEFLGIQPTLGPPNQPPVSTPPTPSPSCPPCPAPPVAGPSVFL

FPPKPKDTLMISRTPEVTCVVVDVSHEDPEVQFNWYVDGVEVHNA

KTKPREEQFNSTFRVVSVLTVVHQDWLNGKEYKCKVSNKGLPAPI

EKTISKTKGQPREPQVYTLPPSREEMTKNQVSLTCLVKGFYPSDI

SVEWESNGQPENNYKTTPPMLDSDGSFFLYSKLTVDKSRWQQGNV

FSCSVLHEALHSHYTQKSLSLSPGK (ACE2-Ig mutein with a CD5 signal peptide,
K74C/S106C/S128C/V343C/C344S/C361S,
A25V/A342V, H345W/F504W,
I259S, C261S, F603G, and an IgA1
upper hinge fused to an IgG2
hinge)

SEQ ID NO: 53

MPMGSLQPLATLYLLGMLVASVLAQSTIEEQVKTFLDKFNHEAED

LFYQSSLASWNYNTNITEENVQNMNNAGDKWSAFLCEQSTLAQMY

PLQEIQNLTVKLQLQALQQNGSCVLSEDKSKRLNTILNTMSTIYC

TGKVCNPDNPQECLLLEPGLNEIMANSLDYNERLWAWESWRSEVG

KQLRPLYEEYVVLKNEMARANHYEDYGDYWRGDYEVNGVDGYDYS

RGQLIEDVEHTFEEIKPLYEHLHAYVRAKLMNAYPSYISPSGSLP

AHLLGDMWGRFWTNLYSLTVPFGQKPNIDVTDAMVDQAWDAQRIF

KEAEKFFVSVGLPNMTQGFWENSMLTDPGNVQKVCSWPTAWDLGK

GDFRILMSTKVTMDDFLTAHHEMGHIQYDMAYAAQPFLLRNGANE

GFHEAVGEIMSLSAATPKHLKSIGLLSPDFQEDNETEINFLLKQA

LTIVGTLPFTYMLEKWRWMVFKGEIPKDQWMKKWWEMKREIVGVV

EPVPHDETYCDPASLWHVSNDYSFIRYYTRTLYQFQFQEALCQAA

KHEGPLHKCDISNSTEAGQKLFNMLRLGKSEPWTLALENVVGAKN

MNVRPLLNYFEPLFTWLKDQNKNSGVGWSTDWSPYADQSTPPTPS

PSCPPCPAPPVAGPSVFLFPPKPKDTLMISRTPEVTCVVVDVSHE

DPEVQFNWYVDGVEVHNAKTKPREEQFNSTFRVVSVLTVVHQDWL

NGKEYKCKVSNKGLPAPIEKTISKTKGQPREPQVYTLPPSREEMT

KNQVSLTCLVKGFYPSDISVEWESNGQPENNYKTTPPMLDSDGSF

FLYSKLTVDKSRWQQGNVFSCSVLHEALHSHYTQKSLSLSPGK (ACE2-Ig mutein with an SAA1 signal peptide.
K74C/S106C/S1280/V343C/0344S/C361S,
A25V/A342V, H345W/F504W,
I259S, C261S, F603G, a collectrin
domain with A714C, and a
full-length IgA1 upper hinge fused
to an IgG2 hinge)

SEQ ID NO: 54

MALSWVLTVLSLLPLLEAQSTIEEQVKTFLDKFNHEAEDLFYQSS

LASWNYNTNITEENVQNMNNAGDKWSAFLCEQSTLAQMYPLQEIQ

NLTVKLQLQALQQNGSCVLSEDKSKRLNTILNTMSTIYCTGKVCN

PDNPQECLLLEPGLNEIMANSLDYNERLWAWESWRSEVGKQLRPL

YEEYVVLKNEMARANHYEDYGDYWRGDYEVNGVDGYDYSRGQLIE

DVEHTFEEIKPLYEHLHAYVRAKLMNAYPSYISPSGSLPAHLLGD

MWGRFWTNLYSLTVPFGQKPNIDVTDAMVDQAWDAQRIFKEAEKF

FVSVGLPNMTQGFWENSMLTDPGNVQKVCSWPTAWDLGKGDFRIL

MSTKVTMDDFLTAHHEMGHIQYDMAYAAQPFLLRNGANEGFHEAV

GEIMSLSAATPKHLKSIGLLSPDFQEDNETEINFLLKQALT1VGT

LPFTYMLEKWRWMVFKGEIPKDQWMKKWWEMKREIVGVVEPVPHD

ETYCDPASLWHVSNDYSFIRYYTRTLYQFQFQEALCQAAKHEGPL

HKCDISNSTEAGQKLFNMLRLGKSEPWTLALENVVGAKNMNVRPL

LNYFEPLFTWLKDQNKNSGVGWSTDWSPYADQSIKVRISLKSALG

DKAYEWNDNEMYLFRSSVAYAMRQYFLKVKNQMILFGEEDVRVAN

LKPRISFNFFVTAPKNVSDITPRTEVEKATRMSRSRTNDCFRLND

NSLEFTGTQPTLGPPNQPPVSTPPTPSTPPTPSPSTPPTPSPSCC

VECPPCPAPPVAGPSVFLFPPKPKDTLMISRTPEVTCVVVDVSHE

DPEVQFNWYVDGVEVHNAKTKPREEQFNSTFRVVSVLTVVHQDWL

NGKEYKCKVSNKGLPAPIEKTISKTKGQPREPQVYTLPPSREEMT

KNQVSLTCLVKGFYPSDISVEWESNGQPENNYKTTPPMLDSDGSF

FLYSKLTVDKSRWQQGNVFSCSVLHEALHSHYTQKSLSLSPGK (ACE2-Ig mutein with a CDS signal peptide,
K74C/S106C/S128C/V343C/C344S/C361S,
A25V/A342V, H345W/F504W,
I259S, C261S, F603G, and a full-length
IgA1 upper hinge fused
to an IgG2 hinge)

SEQ ID NO: 55

MPMGSLQPLATLYLLGMLVASVLAQSTIEEQVKTFLDKFNHEAED

LFYQSSLASWNYNTNITEENVQNMNNAGDKWSAFLCEQSTLAQMY

PLQEIQNLTVKLQLQALQQNGSCVLSEDKSKRLNTILNTMSTIYC

TGKVCNPDNPQECLLLEPGLNEIMANSLDYNERLWAWESWRSEVG

KQLRPLYEEYVVLKNEMARANHYEDYGDYWRGDYEVNGVDGYDYS

RGQLIEDVEHTFEEIKPLYEHLHAYVRAKLMNAYPSYISPSGSLP

AHLLGDMWGRFWTNLYSLTVPFGQKPNIDVTDAMVDQAWDAQRIF

KEAEKEFVSVGLPNMTQGFWENSMLTDPGNVQKVCSWPTAWDLGK

GDFRILMSTKVTMDDFLTAHHEMGHIQYDMAYAAQPFLLRNGANE

GFHEAVGEIMSLSAATPKHLKSIGLLSPDFQEDNETEINFLLKQA

LTIVGTLPFTYMLEKWRWMVFKGEIPKDQWMKKWWEMKREIVGVV

-continued

EPVPHDETYCDPASLWHVSNDYSFIRYYTRTLYQFQFQEALCQAA

KHEGPLHKCDISNSTEAGQKLFNMLRLGKSEPWTLALENVVGAKN

MNVRPLLNYFEPLFTWLKDQNKNSGVGWSTDWSPYADQSTPPTPS

TPPTPSPSTPPTPSPSCCVECPPCPAPPVAGPSVFLFPPKPKDTL

MISRTPEVTCVVVDVSHEDPEVQFNWYVDGVEVHNAKTKPREEQF

NSTFRVVSVLTVVHQDWLNGKEYKCKVSNKGLPAPIEKTISKTKG

QPREPQVYTLPPSREEMTKNQVSLTCLVKGFYPSDISVEWESNGQ

PENNYKTTPPMLDSDGSFFLYSKLTVDKSRWQQGNVFSCSVLHEA

LHSHYTQKSLSLSPGK (mRNA encoding wild-type human ACE2 protein)

SEQ ID NO: 56 agtctagggaaagtcattcagtggatgtgatcttggctcacaggg gacgatgtcaagctcttcctggctccttctcagccttgttgctgt aactgctgctcagtccaccattgaggaacaggccaagacattttt ggacaagtttaaccacgaagccgaagacctgttctatcaaagttc acttgcttcttggaattataacaccaatattactgaagagaatgt ccaaaacatgaataatgctggggacaaatggtctgccttttaaa ggaacagtccacacttgcccaaatgcatccactacaagaaattca gaatctcacagtcaagcttcagctgcaggctcttcagcaaaatgg gtcttcagtgctctcagaagacaagagcaaacggttgaacacaat tctaaatacaatgagcaccatctacagtactggaaaagtttgtaa cccagataatccacaagaatgcttattacttgaaccaggtttgaa tgaaataatggcaaacagtttagactacaatgagaggctctgggc ttgggaaagctggagatctgaggtcggcaagcagctgaggccatt atatgaagagtatgtggtcttgaaaaatgagatggcaagagcaaa tcattatgaggactatgggggattattggagaggagactatgaagt aaatggggtagatggctatgactacagccgcggccagttgattga agatgtggaacatacctttgaagagattaaaccattatatgaaca tcttcatgcctatgtgagggcaaagttgatgaatgcctatccttc ctatatcagtccaattggatgcctccctgctcatttgcttggtga tatgtgggggtagattttggacaaatctgtactctttgacagttcc ctttggacagaaaccaaacatagatgttactgatgcaatggtgga ccaggcctgggatgcacagagaatattcaaggaggccgagaagtt ctttgtatctgttggtcttcctaatatgactcaaggattctggga aaattccatgctaacggacccaggaaatgttcagaaagcagtctg ccatcccacagcttgggacctggggaagggcgacttcaggatcct tatgtgcacaaaggtgacaatggacgacttcctgacagctcatca tgagatggggcatatccagtatgatatggcatatgctgcacaacc ttttctgctaagaaatggagctaatgaaggattccatgaagctgt tggggaaatcatgtcactttctgcagccacacctaagcatttaaa atccattggtcttctgtcacccgattttcaagaagacaatgaaac -continued agaaataaacttcctgctcaaacaagcactcacgattgttgggac tctgccatttacttacatgttagagaagtggaggtggatggtctt taaaggggaaattcccaaagaccagtggatgaaaaagtggtggga gatgaagcgagagatagttgggggtggtggaacctgtgccccatga tgaaacatactgtgaccccgcatctctgttccatgtttctaatga ttactcattcattcgatattacacaaggacccttttaccaattcca gtttcaagaagcactttgtcaagcagctaaacatgaaggccctct gcacaaatgtgacatctcaaactctacagaagctggacagaaact gttcaatatgctgaggcttggaaaatcagaaccctggaccctagc attggaaaatgttgtaggagcaaagaacatgaatgtaaggccact gctcaactactttgagcccttatttacctggctgaaagaccagaa caagaattcttttgtgggatggagtaccgactggagtccatatgc agaccaaagcatcaaagtgaggataagcctaaaatcagctcttgg agataaagcatatgaatggaacgacaatgaaatgtacctgttccg atcatctgttgcatatgctatgaggcagtactttttaaaagtaaa aaatcagatgattcttttggggaggaggatgtgcgagtggctaa tttgaaaccaagaatctccttttaatttctcttgtcactgcacctaa aaatgtgtctgatatcattcctagaactgaagttgaaaaggccat caggatgtcccggagccgtatcaatgatgctttccgtctgaatga caacagcctagagtttctggggatacagccaacacttggacctcc taaccagccccctgtttccatatggctgattgtttttggagttgt gatgggagtgatagtggttggcattgtcatcctgatcttcactgg gatcagagatcggaagaagaaaaataaagcaagaagtggagaaaa tccttatgcctccatcgatattagcaaaggagaaaataatccagg attccaaaacactgatgatgttcagacctccttttagaaaaatct atgtttttcctcttgaggtgattttgttgtatgtaaatgttaatt tcatggtatagaaaatataagatgataaagatatcattaaatgtc aaaactatgactctgttcagaaaaaaaattgtccaaagacaacat ggccaaggagagagcatcttcattgacattgctttcagtatttat ttctgtctctggatttgacttctgttctgtttcttaataaggatt ttgtattagagtatattaggggaaagtgtgtatttggtctcacagg ctgttcaggggataatctaaatgtaaatgtctgttgaatttctgaa gttgaaaacaaggatatatcattggagcaagtgttggatcttgta tggaatatggatggatcacttgtaaggacagtgcctgggaactgg tgtagctgcaaggattgagaatggcatgcattagctcactttcat ttaatccattgtcaaggatgacatgctttcttcacagtaactcag ttcaagtactatggtgatttgcctacagtgatgtttggaatcgat catgctttcttcaaggtgacaggtctaaagagagaagaatccagg gaacaggtagaggacattgcttttttcacttccaaggtgcttgatc aacatctccctgacaacacaaaactagagccaggggcctccgtga actcccagagcatgcctgatagaaactcatttctactgttctcta -continued actgtggagtgaatggaaattccaactgtatgttcaccctctgaa gtgggtacccagtctcttaaatcttttgtatttgctcacagtgtt tgagcagtgctgagcacaaagcagacactcaataaatgctagatt tacacactc (nucleotide sequence encoding an ACE2-Ig mutein
with A25V/L29F/K74C/S106C/I259T/C261P/
V339G/A342V/H345Y/A386L/
V620I/I622L/A650V/L656S/L664G/V685L/
I695T/A714C and an IgG2
hinge and Fc directly fused to ACE2)

SEQ ID NO: 57 gctagccgccaccatgtcaagctctagctggctcctgctcagcct cgtcgccgtaaccgccgcacagagcaccattgaagaacaagtcaa aacattctttgacaaattcaaccacgaagccgaagacctgttcta ccaaagctcactcgcaagctggaactacaacacaaacatcaccga agagaacgtccaaaacatgaacaacgccggagacaaatggagcgc attcctctgtgaacaaagcacactcgcccaaatgtacccactcca agaaatccaagacctgaccgtcaagctgcagctgcaggcactgca gcagaacggaagctgtgtactgagcgaagacaaatccaaacgcct aaacacaatactaaacacaatgagcacaatctacagcaccggaaa agtatgcaacccagacaatccacaagaatgcctgctgctggaacc cggactcaacgaaatcatggccaactcsctagactacaacgaaag actctgggcatgggaaagctggcgctcagaagtcggcaaacaact cagaccactctatgaagaatacgtagtcctcaaaaatgaaatggc acgcgcaaaccactacgaagactacggcgactactggagaggcga ctacgaagtaaacggagtcgacggctacgactactcaagaggaca actaatagaagacgtcgaacacacattcgaagaaatcaaaccact ctacgaacacctccacgcatacgtacgagcaaaactcatgaacgc ctacccatcatacatcagcccaacaggaccactaccagcacacct actaggcgacatgtggggaagattctggacaaacctgtacagcct gacagtaccattcggacagaaaccaaacatagacgtcaccgacgc aatggtcgaccaagcctgggacgcacagagaatattcaaagaagc cgaaaaattcttcgtatccgtcggactccccaacatgacacaagg attctgggaaaactccatgctgacagaccccggaaacggccagaa agtcgtctgctacccaacagcctgggacctaggcaaaggcgactt cagaatcctgatgtgcaccaaagtcacaatggacgacttcctgac agcccaccacgaaatgggccacatccaatacgacatggcatacct ggcacaaccattcctactacgcaacggagccaacgaaggattcca cgaagccgtcggcgaaatcatgtcactgagtgcagccacacccaa gcacctgaaaagcatcggactgctgagcccagacttccaagaaga caacgaaaccgaaataaacttcctactaaaacaagcactgacaat cgtcggaaccctgccattcacctacatgctggaaaatggagatg gatggtcttcaaaggagaaatcccaaaagaccagtggatgaaaaa atggtgggaaatgaaacgcgaaatagtaggagtcgtcgaaccagt -continued -continued

```
VEHTFEEIKPLYEHLHAYVRAKLMNAYPSYISPTGPLPAHLLGDM

WGRFWTNLYSLTVPFGQKPNIDVTDAMVDQAWDAQRIFKEAEKFF

VSVGLPNMTQGFWENSMLTDPGNGQKVVCYPTAWDLGKGDFRILM

CTKVTMDDFLTAHHEMGHIQYDMAYLAQPFLLRNGANEGFHEAVG

EIMSLSAATPKHLKSIGLLSPDFQEDNETEINFLLKQALTLVGTL

PHTYMLEKWRWMV#KGELPKDQWMKKWWEMKRELVGVVEPVPHDE

TYCDPASLFHVSNDYSFTRYYTRTLYQFQFQEALCQAAKHEGPLH

KCDISNSTEAGQKLFNMLRLGKSEPWTLALENVVGAKNMNVRPLL

NYFEPLFTWLKDQNKNSFVGWSTDWSPYADQSIKIRLSLKSALGD

KAYEWNDNEMYLFRSSVAYVMRQYFSKVKNQMIGFGEEDVRVANL

KPRISFNFFLTAPKNVSDITPRTEVEKAIRMSRSRINDCFRLNDN

SLEFLGIQPTLGPPNQPPVECPPCPAPPVAGPSVFLFPPKPKDTL

MISRTPEVTCVVVDVSHEDPEVQFNWYVDGVEVHNAKTKPREEQF

NSTFRVVSVLTVVHQDWLNGKEYKCKVSNKGLPAPIEKTISKTKG

QPREPQVYTLPPSREEMTKNQVSLTCLVKGFYPSDISVEWESNGQ

PENNYKTTPPMLDSDGSFFLYSKLTVDKSRWQQGNVFSCSVLHEA

LHSHYTQKSLSLSPGK-
```

(nucleotide sequence encoding an ACE2-Ig mutein
with A25V/L29F/K74C/S106C/I259T/C261P/
V339G/A342V/H345Y/A386L/
V620I/I622L/A650V/L656S/L664G/V685L/I695T/
A714C and an IgA1
hinge and an IgG2 Fc)

SEQ ID NO: 59

```
gctagccgccaccatgtcaagctctagctggctcctgctcagcct cgtcgccgtaaccgccgcacagagcaccattgaagaacaagtcaa aacattctttgacaaattcaaccacgaagccgaagacctgttcta ccaaagctcactcgcaagctggaactacaacacaaacatcaccga agagaacgtccaaaacatgaacaacgccggagacaaatggagcgc attcctctgtgaacaaagcacactcgcccaaatgtacccactcca agaaatccaagacctgaccgtcaagctgcagctgcaggcactgca gcagaacggaagctgtgtactgagcgaagacaaatccaaacgcct aaacacaatactaaacaatgagcacaatctacagcaccggaaa agtatgcaacccagacaatccacaagaatgcctgctgctggaacc cggactcaacgaaatcatggccaactcactagactacaacgaaag actctgggcatgggaaagctggcgctcagaagtcggcaaacaact cagaccactctatgaagaatacgtagtcctcaaaaatgaaatggc acgcgcaaaccactacgaagactacggcgactactggagaggcga ctacgaagtaaacggagtcgacggctacgactactcaagaggaca actaatagaagacgtcgaacacacattcgaagaaatcaaaccact ctacgaacacctccacgcatacgtacgagcaaaactcatgaacgc ctacccatcatacatcagcccaacaggaccactaccagcacacct actaggcgacatgtggggaagattctggacaaacctgtacagcct gacagtaccattcggacagaaaccaaacatagacgtcaccgacgc
```

```
aatggtcgaccaagcctgggacgcacagagaatattcaaagaagc cgaaaaattcttcgtatccgtcggactccccaacatgacacaagg attctgggaaaactccatgctgacagaccccggaaacggccagaa agtcgtctgctacccaacagcctgggacctaggcaaaggcgactt cagaatcctgatgtgcaccaaagtcacaatggacgacttcctgac agcccaccacgaaatgggccacatccaatacgacatggcatacct ggcacaaccattcctactacgcaacggagccaacgaaggattcca cgaagccgtcggcgaaatcatgtcactgagtgcagccacacccaa gcacctgaaaagcatcggactgctgagcccagacttccaagaaga caacgaaaccgaaataaacttcctactaaaacaagcactgacaat cgtcggaaccctgccattcacctacatgctggaaaaatggagatg gatggtcttcaaaggagaaatcccaaaagaccagtggatgaaaaa atggtgggaaatgaaacgcgaaatagtaggagtcgtcgaaccagt accacacgacgaaacatactgcgacccagcatcactattccacgt atcaaacgactacagcttcatacgctactacacaagaacactgta ccaattccaattccaagaagcactatgccaagcagccaagcacga aggcccactgcacaaatgcgacatcagcaactccaccgaagccgg acagaagctcttcaacatgctgagactgggaaaatcagaaccatg gaccctggcactggaaaacgtagtcggagccaagaacatgaacgt acgaccactcctcaactacttcgaaccactcttcacatggctcaa agaccaaaacaagaattcatttgtaggatggagcacagactggag cccatatgctgatcaaagcatcaaaatcagactgtcactaaaatc agcactaggagacaaagcctatgaatggaatgacaatgagatgta cctgtttagaagctctgtagcctatgtcatgagacaatacttcag caaagtcaaaaaccagatgattggatttggagaagaagatgtcag agtagccaatctgaagcctagaatcagcttcaacttctttctgac tgcacctaagaatgtatcagacatcactccaagaacagaagtaga aaaagccatcagaatgagcagaagcagaatcaatgactgcttcag actgaatgacaacagcctggagttcctgggaatccagcctacact gggaccaccaaaccaaccaccagtatcaacaccacctacaccaag tccaagcacaccaccaacaccaagccatcatgctgtgtagaatg tccaccatgcccagcaccaccagtagcaggaccaagtgtattcct attcccaccaaagccaaaagacacactaatgatatctagaacacc tgaagtgacctgtgtagtagtagatgtatcccatgaagaccctga agtccaattcaattggtatgtggatggagtggaagtacacaatgc caagaccaaaccaagagaagagcaattcaatagcacattcagagt agtatctgtactcactgtagtgcaccaagactggctcaatggcaa agaatacaaatgcaaagtgtccaacaaaggactccctgcaccaat tgaaaagactatctccaagaccaaaggacaaccaagagagccaca agtctacacactgccaccaagtagagaagagatgaccaagaacca
```

```
5

10

15

20

25

30

35

40

45

50

55

60

65
```

-continued agtatcactgacatgccttgtcaaaggattctaccctagtgacat tagtgtagaatgggaaagtaatggacaacctgaaaacaactacaa gacaacaccaccaatgctggatagtgatggcagcttcttcctgta ctcaaaactgactgtagacaaaagtagatggcaacaaggaaatgt gtttagctgttctgtactgcatgaagcactgcacagccactacac acaaaaaagcctgagtctgagccctggcaagtgataggatcc (amino acid sequence encoding an ACE2-Ig mutein
with A25V/L29F/K740/S106C/I259T/C261P/
V339G/A342V/H345Y/A386L/
V620I/I622L/A650V/L656S/L664G/V685L/
I695T/A714C and an IgA1
hinge and an IgG2 Fc)

SEQ ID NO: 60

MSSSSWLLLSLVAVTAAQSTIEEQVKTFFDKFNHEAEDLFYQSSL

ASWNYNTNITEENVQNMNNAGDKWSAFLCEQSTLAQMYPLQEIQD

LTVKLQLQALQQNGSCVLSEDKSKRLNTILNTMSTIYSTGKVCNP

DNPQECLLLEPGLNEIMANSLDYNERLWAWESWRSEVGKQLRPLY

EEYVVLKNEMARANHYEDYGDYWRGDYEVNGVDGYDYSRGQLIED

VEHTFEEIKPLYEHLHAYVRAKLMNAYPSYISPTGPLPAHLLGDM

WGRFWTNLYSLTVPFGQKPNIDVTDAMVDQAWDAQRIFKEAEKFF

VSVGLPNMTQGFWENSMLTDPGNGQKVVCYPTAWDLGKGDFRILM

CTKVTMDDFLTAHHEMGHIQYDMAYLAQPFLLRNGANEGFHEAVG

EIMSLSAATPKHLKSIGLLSPDFQEDNETEINFLLKQALTIVGTL

PFTYMLEKWRWMVFKGEIPKDQWMKKWWEMKREIVGVVEPVPHDE

TYCDPASLFHVSNDYSFIRYYTRTLYQFQFQEALCQAAKHEGPLH

KCDISNSTEAGQKLFNMLRLGKSEPWTIALENVVGAKNMNVRPLL

NYFEPLFTWLKDQNKNSFVGWSTDWSPYADQSIKIRLSLKSALGD

KAYEWNDNEMYLFRSSVAYVMRQYFSKVKNQMIGFGEEDVRVANL

KPRISFNFFLTAPKNVSDITPRTEVEKAIRMSRSRTNDCFRLNDN

SLEFLGTQPTLGPPNQPPVSTPPTPSPSTPPTPSPSCCVECPPCP

APPVAGPSVFLFPPKPKDTLMISRTPEVTCVVVDVSHEDPEVQFN

WYVDGVEVHNAKTKPREEQFNSTFRVVSVLTVVHQDWLNGKEYKC

KVSNKGLPAPIEKTISKTKGQPREPQVYTLPPSREEMTKNQVSLT

CLVKGFYPSDISVEWESNGQPENNYKTTPPMLDSDGSFFLYSKLT

VDKSRWQQGNVFSCSVLHEALHSHYTQKSLSLSPGK- (nucleotide sequence encoding an ACE2-Ig mutein
with A25V/L29F/K74C/S106C/I259T/C261P/
V339G/A342V/H345Y/A386L/
V620I/I622L/A650V/L656S/L664G/V685L/
I695T/A714C and an IgA2
hinge and an IgG2 Fc)

SEQ ID NO: 61 gctagccgccaccatgtcaagctctagctggctcctgctcagcct cgtcgccgtaaccgccgcacagagcaccattgaagaacaagtcaa aacattctttgacaaattcaaccacgaagccgagacctgttcta ccaaagctcactcgcaagctggaactacaacacaaacatcaccga agagaacgtccaaaacatgaacaacgccgagacaaatggacgc attcctctgtgaacaaagcacactcgcccaaatgtacccactcca -continued agaaatccaagacctgaccgtcaagctgcagctgcaggcactgca gcagaacggaagctgtgtactgagcgaagacaaatccaaacgcct aaacacaatactaaacacaatgagcacaatctacagcaccggaaa agtatgcaacccagacaatccacaagaatgcctgctgctggaacc cggactcaacgaaatcatggccaactcactagactacaacgaaag actctgggcatgggaaagctggcgctcagaagtcggcaaacaact cagaccactctatgaagaatacgtagtcctcaaaaatgaaatggc acgcgcaaaccactacgaagactacggcgactactggagaggcga ctacgaagtaaacggagtcgacggctacgactactcaagaggaca actaatagaagacgtcgaacacacattcgaagaaatcaaaccact ctacgaacacctccacgcatacgtacgagcaaaactcatgaacgc ctacccatcatacatcagcccaacaggaccactaccagcacacct actaggcgacatgtggggaagattctggacaaacctgtacagcct gacagtaccattcggacagaaaccaaacatagacgtcaccgacgc aatggtcgaccaagcctgggacgcacagagaatattcaaagaagc cgaaaaattcttcgtatccgtcggactccccaacatgacacaagg attctgggaaaactccatgctgacagaccccggaaacggccagaa agtcgtctgctacccaacagcctgggacctaggcaaaggcgactt cagaatcctgatgtgcaccaaagtcacaatggacgacttcctgac agcccaccacgaaatgggccacatccaatacgacatggcatacct ggcacaaccattcctactacgcaacgggagccaacgaaggattcca cgaagccgtcggcgaaatcatgtcactgagtgcagccacacccaa gcacctgaaaagcatcggactgctgagcccagacttccaagaaga caacgaaaccgaaataaacttcctactaaaacaagcactgacaat cgtcggaaccctgccattcacctacatgctggaaaaatggagatg gatggtcttcaaaggagaaatcccaaaagaccagtggatgaaaaa atggtgggaaatgaaacgcgaaatagtaggagtcgtcgaaccagt accacacgacgaaacatactgcgacccagcatcactattccacgt atcaaacgactacagcttcatacgctactacacaagaacactgta ccaattccaattccaagaagcactatgccaagcagccaagcacga aggcccactgcacaaatgcgacatcagcaactccaccgaagccgg acagaagctcttcaacatgctgagactgggaaaatcagaaccatg gaccctggcactggaaaacgtagtcggagccaagaacatgaacgt acgaccactcctcaactacttcgaaccactcttcacatggctcaa agaccaaaacaagaattcatttgtaggatggagcacagactggag cccatatgctgatcaaagcatcaaaatcagactgtcactaaaatc agcactaggagacaaagcctatgaatggaatgacaatgagatgta cctgtttagaagctctgtagcctatgtcatgagacaatacttcag caaagtcaaaaaccagatgattggatttggagaagaagatgtcag agtagccaatctgaagcctagaatcagcttcaacttctttctgac -continued tgcacctaagaatgtatcagacatcactccaagaacagaagtaga aaaagccatcagaatgagcagaagcagaatcaatgactgcttcag actgaatgacaacagcctggagttcctgggaatccagcctacact gggaccaccaaaccaaccaccaccaccaccatgctgtgtagaatg tccaccttgcccagcaccaccagtagcaggaccaagtgtattcct attcccaccaaagccaaaagacacactaatgatatctagaacacc tgaagtgacctgtgtagtagtagatgtatcccatgaagaccctga agtccaattcaattggtatgtggatggagtggaagtacacaatgc caagaccaaaccaagagaagagcaattcaatagcacattcagagt agtatctgtactcactgtagtgcaccaagactggctcaatggcaa agaatacaaatgcaaagtgtccaacaaaggactccctgcaccaat tgaaaagactatctccaagaccaaaggacaaccaagagagccaca agtctacacactgccaccaagtagagaagagatgaccaagaacca agtatcactgacatgccttgtcaaaggattctaccctagtgacat tagtgtagaatgggaaagtaatggacaacctgaaaacaactacaa gacaacaccaccaatgctggatagtgatggcagcttcttcctgta ctcaaaactgactgtagacaaaagtagatggcaacaaggaaatgt gtttagctgttctgtactgcatgaagcactgcacagccactacac acaaaaaagcctgagtctgagccctggcaagtgataggatcc (amino acid sequence encoding an ACE2-Ig mutein
with A25V/L29F/K74C/S106C/I259T/C261P/
V339G/A342V/H345Y/A386L/
V620I/I622L/A650V/L6568/L664G/
V685L/I695T/A714C and an IgA2
hinge and an IgG2 Fc)
SEQ ID NO: 62

MSSSSWLLLSLVAVTAAQSTIEEQVKTFFDKFNHEAEDLFYQSSL

ASWNYNTNITEENVQNMNNAGDKWSAFLCEQSTLAQMYPLQEIQD

LTVKLQLQALQQNGSCVLSEDKSKRLNTILNTMSTIYSTGKVCNP

DNPQECLLLEPGLNEIMANSLDYNERLWAWESWRSEVGKQLRPLY

EEYVVLKNEMARANHYEDYGDYWRGDYEVNGVDGYDYSRGQLIED

VEHTFEEIKPLYEHLHAYVRAKLMNAYPSYISPTGPLPAHLLGDM

WGRFWTNLYSLTVPFGQKPNIDVTDAMVDQAWDAQRIFKEAEKFF

VSVGLPNMTQGFWENSMLTDPGNGQKVVCYPTAWDLGKGDFRILM

CTKVTMDDFLTAHHEMGHTQYDMAYLAQPFLLRNGANEGFHEAVG

ETMSLSAATPKHLKSIGLLSPDFQEDNETEINFLLKQALTLVGTL

PHTYMLEKWRWMV#KGELPKDQWMKKWWEMKRELVGVVEPVPHDE

TYCDPASLFHVSNDYSFIRYYTRTLYQFQFQEALCQAAKHEGPLH

KCDISNSTEAGQKLFNMLRLGKSEPWTLALENVVGAKNMNVRPLL

NYFEPLFTWLKDQNKNSFVGWSTDWSPYADQSIKIRLSLKSALGD

KAYEWNDNEMYLFRSSVAYVMRQYFSKVKNQMIGFGEEDVRVANL

KPRISFNFFLTAPKNVSDITPRTEVEKAIRMSRSRINDCFRLNDN

SLEFLGIQPTLGPPNQPPPPPCCVECPPCPAPPVAGPSVFLFPPK

PKDTLMISRTPEVTCVVVDVSHEDPEVQFNWYVDGVEVHNAKTKP

-continued

REEQFNSTFRVVSVLTVVHQDWLNGKEYKCKVSNKGLPAPIEKTI

SKTKGQPREPQVYTLPPSREEMTKNQVSLTCLVKGFYPSDISVEW

ESNGQPENNYKTTPPMLDSDGSFFLYSKLTVDKSRWQQGNVFSCS

VLHEALHSHYTQKSLSLSPGK- (nucleotide sequence encoding an ACE2-Ig mutein
with A25V/L29F/K74C/S106C/I259T/C261P/
V339G/A342V/H345Y/A386L/
V620I/I622L/A650V/L656S/L664G/V685L/I695T/
A714C and an IgG1
hinge and IgG1 Fc fused directly to ACE2)
SEQ ID NO: 63 gctagccgccaccatgtcaagctctagctggctcctgctcagcct cgtcgccgtaaccgccgcacagagcaccattgaagaacaagtcaa aacattctttgacaaat tcaaccacgaagccgaagacctgttctaccaaagctcactcgcaa gctggaactacaacacaaacatcaccgaagagaacgtccaaaaca tgaacaacgccggagacaaatggagcgcattcctctgtgaacaaa gcacactcgcccaaatgtaccccactccaagaaatccaagacctga ccgtcaagctgcagctgcaggcactgcagcagaacggaagctgtg tactgagcgaagacaaatccaaacgcctaaacacaatactaaaca caatgagcacaatctacagcaccggaaaagtatgcaacccagaca tccacaagaatgcctgctgctggaacccggactcaacgaaatca tggccaactcactagactacaacgaaagactctgggcatgggaaa gctggcgctcagaagtcggcaaacaactcagaccactctatgaag aatacgtagtcctcaaaaatgaaatggcacgcgcaaaccactacg aagactacggcgactactggagaggcgactacgaagtaaacggag tcgacggctacgactactcaagaggacaactaatagaagacgtcg aacacacattcgaagaaatcaaaccactctacgaacacctccacg catacgtacgagcaaaactcatgaacgcctacccatcatacatca gcccaacaggaccactaccagcacacctactaggcgacatgtggg gaagattctggacaaacctgtacagcctgacagtaccattcggac agaaaccaaacatagacgtcaccgacgcaatggtcgaccaagcct gggacgcacagagaatattcaaagaagccgaaaaattcttcgtat ccgtcggactccccaacatgacacaaggattctgggaaaactcca tgctgacagaccccggaaacggccagaaagtcgtctgctacccaa cagcctgggacctaggcaaaggcgacttcagaatcctgatgtgca ccaaagtcacaatggacgacttcctgacagcccaccacgaaatgg gccacatccaatacgacatggcatacctggcacaaccattcctac tacgcaacggagccaacgaaggattccacgaagccgtcggcgaaa tcatgtcactgagtgcagccacacccaagcacctgaaaagcatcg gactgctgagcccagacttccaagaagacaacgaaaccgaaataa acttcctactaaaacaagcactgacaatcgtcggaaccctgccat tcacctacatgctggaaaaatggagatgatggtcttcaaaggag aaatcccaaaagaccagtggatgaaaaaatggtgggaaatgaaac -continued gcgaaatagtaggagtcgtcgaaccagtaccacacgacgaaacat actgcgacccagcatcactattccacgtatcaaacgactacagct tcatacgctactacacaagaacactgtaccaattccaattccaag aagcactatgccaagcagccaagcacgaaggcccactgcacaaat gcgacatcagcaactccaccgaagccggacagaagctcttcaaca tgctgagactgggaaaatcagaaccatggaccctggcactggaaa acgtagtcggagccaagaacatgaacgtacgaccactcctcaact acttcgaaccactcttcacatggctcaaagaccaaaacaagaatt catttgtaggatggagcacagactggagcccatatgctgatcaaa gcatcaaaatcagactgtcactaaaatcagcactaggagacaaag cctatgaatggaatgacaatgagatgtacctgtttagaagctctg tagcctatgtcatgagacaatacttcagcaaagtcaaaaaccaga tgattggatttggagaagaagatgtcagagtagccaatctgaagc ctagaatcagcttcaacttctttctgactgcacctaagaatgtat cagacatcactccaagaacagaagtagaaaaagccatcagaatga gcagaagcagaatcaatgactgcttcagactgaatgacaacagcc tggagttcctgggaatccagcctacactgggaccaccaaaccaac caccagtaagtgacaagacgcacacctgcccgccgtgtcccgccc ctgaggcagccggtggccccagtgtgttcctgttcccgcctaaac ctaaggacacactgatgatctcaagaacccctgaggtgacgtgcg ttgttgttgacgtgtcccatgaagatccagaagttaagttcaact ggtatgtggatggagtggaagttcataacgccaagaccaaaccca gagaggagcaatacaacagcacttatagagttgttagtgttctca cagtgctccaccaggattggctgaacggcaaggaatacaagtgta aagtgtccaacaaggctttgcccgcgcctatcgaaaagactatct ctaaagcgaaaggccagccaagagaaccacaggtttatacctcc caccaagcagagaggaaatgactaaaaatcaggtgtcactcacct gtttggtgaagggcttctacccctccgacatcgctgttgaatggg agtccaacggccagccagaaataactataagacaacgccgccag tacttgactctgacgggtccttcttcttatattcaaagctgaccg tcgacaaatccaggtggcagcagggaaacgcattcagctgcagtg tactgcacgaggctttacatagccattatacccagaagtcactaa gccctggcaagtgataggatcc (amino acid sequence encoding an ACE2-Ig mutein
with A25V/L29F/K74C/S106C/I259T/C261P/
V339G/A342V/H345Y/A386L/
V620I/I622L/A650V/L656S/L664G/V685L/
I695T/A714C and an IgG1
hinge and IgG1 Fc fused directly to ACE2)

SEQ ID NO: 64

MSSSSWLLLSLVAVTAAQSTIEEQVKTFFDKFNHEAEDLFYQSSL

ASWNYNTNITEENVQNMNNAGDKWSAFLCEQSTLAQMYPLQEIQD

LTVKLQLQALQQNGSCVLSEDKSKRLNTILNTMSTIYSTGKVCNP

DNPQECLLLEPGLNEIMANSLDYNERLWAWESWRSEVGKQLRPLY

-continued

EEYVVLKNEMARANHYEDYGDYWRGDYEVNGVDGYDYSRGQLIED

VEHTFEEIKPLYEHLHAYVRAKLMNAYPSYISPTGPLPAHLLGDM

WGRFWTNLYSLTVPFGQKPNIDVTDAMVDQAWDAQRIFKEAEKFF

VSVGLPNMTQGFWENSMLTDPGNGQKVVCYPTAWDLGKGDFRILM

CTKVTMDDFLTAHHEMGHIQYDMAYLAQPFLLRNGANEGFHEAVG

EIMSLSAATPKHLKSIGLLSPDFQEDNETEINFLLKQALTIVGTL

PFTYMLEKWRWMVFKGEIPKDQWMKKWWEMKREIVGVVEPVPHDE

TYCDPASLFHVSNDYSFTRYYTRTLYQFQFQEALCQAAKHEGPLH

KCDISNSTEAGQKLFNMLRLGKSEPWTLALENVVGAKNMNVRPLL

NYFEPLFTWLKDQNKNSFVGWSTDWSPYADQSIKIRLSLKSALGD

KAYEWNDNEMYLFRSSVAYVMRQYFSKVKNQMIGFGEEDVRVANL

KPRISFNFFLTAPKNVSDITPRTEVEKAIRMSRSRINDCFRLNDN

SLEFLGIQPTLGPPNQPPVSDKTHTCPPCPAPELLGGPSVFLFPP

KPKDTLMISRTPEVTCVVVDVSHEDPEVKFNWYVDGVEVHNAKTK

PREEQYNSTYRVVSVLTVLHQDWLNGKEYKCKVSNKALPAPIEKT

ISKAKGQPREPQVYTLPPSREEMTKNQVSLTCLVKGFYPSDIAVE

WESNGQPENNYKTTPPVLDSDGSFFLYSKLTVDKSRWQQGNVFSC

SVLHEALHSHYTQKSLSPGK- (nucleotide sequence encoding an ACE2-Ig mutein
with A25V/L29F/K74C/S106C/I259T/C261P/V339G/
A342V/H345Y/A386L/V620I/I622L/A650V/L6568/
L664G/V685L/I695T/A714C and an
L234A/L235A "LALA" lower hinge and IgG1 Fc
fused directly to
ACE2)

SEQ ID NO: 65 gctagccgccaccatgtcaagctctagctggctcctgctcagcct cgtcgccgtaaccgccgcacagagcaccattgaagaacaagtcaa aacattctttgacaaattcaaccacgaagccgaagacctgttcta ccaaagctcactcgcaagctggaactacaacacaaacatcaccga agagaacgtccaaaacatgaacaacgccggagacaaatggagcgc attcctctgtgaacaaagcacactcgcccaaatgtacccactcca agaaatccaagacctgaccgtcaagctgcagctgcaggcactgca gcagaacggaagctgtgtactgagcgaagacaaatccaaacgcct aaacacaatactaaacacaatgagcacaatctacagcaccggaaa agtatgcaacccagacaatccacaagaatgcctgctgctggaacc cggactcaacgaaatcatggccaactcactagactacaacgaaag actctgggcatgggaaagctggcgctcagaagtcggcaaacaact cagaccactctatgaagaatacgtagtcctcaaaaatgaaatggc acgcgcaaaccactacgaagactacggcgactactgagaggcga ctacgaagtaaacggagtcgacggctacgactactcaagaggaca actaatagaagacgtcgaacacacattcgaagaaatcaaaccact ctacgaacacctccacgcatacgtacgagcaaaactcatgaacgc ctacccatcatacatcagcccaacaggaccactaccagcacacct actaggcgacatgtggggaagattctggacaaacctgtacagcct -continued gacagtaccattcggacagaaaccaaacatagacgtcaccgacgc aatggtcgaccaagcctgggacgcacagagaatattcaaagaagc cgaaaaattcttcgtatccgtcggactccccaacatgacacaagg attctgggaaaactccatgctgacagaccccggaaacggccagaa agtcgtctgctacccaacagcctgggacctaggcaaaggcgactt cagaatcctgatgtgcaccaaagtcacaatggacgacttcctgac agcccaccacgaaatgggccacatccaatacgacatggcatacct ggcacaaccattcctactacgcaacggagccaacgaaggattcca cgaagccgtcggcgaaatcatgtcactgagtgcagccacacccaa gcacctgaaaagcatcggactgctgagcccagacttccaagaaga caacgaaaccgaaataaacttcctactaaaacaagcactgacaat cgtcggaaccctgccattcacctacatgctggaaaaatggagatg gatggtcttcaaaggagaaatcccaaaagaccagtggatgaaaaa atggtgggaaatgaaacgcgaaatagtaggagtcgtcgaaccagt accacacgacgaaacatactgcgacccagcatcactattccacgt atcaaacgactacagcttcatacgctactacacaagaacactgta ccaattccaattccaagaagcactatgccaagcagccaagcacga aggcccactgcacaaatgcgacatcagcaactccaccgaagccgg acagaagctcttcaacatgctgagactgggaaaatcagaaccatg gaccctggcactggaaaacgtagtcggagccaagaacatgaacgt acgaccactcctcaactacttcgaaccactcttcacatggctcaa agaccaaaacaagaattcatttgtaggatggagcacagactggag cccatatgctgatcaaagcatcaaaatcagactgtcactaaaatc agcactaggagacaaagcctatgaatggaatgacaatgagatgta cctgtttagaagctctgtagcctatgtcatgagacaatacttcag caaagtcaaaaaccagatgattggatttggagaagaagatgtcag agtagccaatctgaagcctagaatcagcttcaacttctttctgac tgcacctaagaatgtatcagacatcactccaagaacagaagtaga aaaagccatcagaatgagcagaagcagaatcaatgactgcttcag actgaatgacaacagcctggagttcctgggaatccagcctacact gggaccaccaaaccaaccaccagtaagtgacaagacgcacctg cccgccgtgtcccgcccctgagctactgggtggcccagtgtgtt cctgttcccgcctaaacctaaggacacactgatgatctcaagaac ccctgaggtgacgtgcgttgttgttgacgtgtcccatgaagatcc agaagttaagttcaactggtatgtggatggagtggaagttcataa cgccaagaccaaacccagagaggagcaatacaacagcacttatag agttgttagtgttctcacagtgctccaccaggattggctgaacgg caaggaatacaagtgtaaagtgtccaacaaggctttgcccgcgcc tatcgaaaagactatctctaaagcgaaaggccagccaagagaacc acaggtttatacctcccaccaagcagagaggaaatgactaaaaa tcaggtgtcactcacctgtttggtgaagggcttctaccctccga catcgctgttgaatgggagtccaacggccagccagaaataacta taagacaacgccgccagtacttgactctgacgggtccttcttct atattcaaagctgaccgtcgacaaatccaggtggcagcagggaa cgtattcagctgcagtgtactgcacgaggctttacatagccatta tacccagaagtcactaagccctggcaagtgataggatcc (amino acid sequence encoding an ACE2-Ig mutein
with A25V/L29F/K74C/S106C/I259T/C261P/V339G/
A342V/H345Y/A386L/V620I/I622L/A650V/L656S/
L664G/V685L/I695T/A714C and an
L234A/L235A "LALA" lower hinge and IgG1 Fc
fused directly to ACE 2)
SEQ ID NO: 66

MSSSSWLLLSLVAVTAAQSTIEEQVKTFEDKFNHEAEDLFYQSSL

ASWNYNTNITEENVQNMNNAGDKWSAFLCEQSTLAQMYPLQEIQD

LTVKLQLQALQQNGSCVLSEDKSKRLNTILNTMSTIYSTGKVCNP

DNPQECLLLEPGLNEIMANSLDYNERLWAWESWRSEVGKQLRPLY

EEYVVLKNEMARANHYEDYGDYWRGDYEVNGVDGYDYSRGQLIED

VEHTFEEIKPLYEHLHAYVRAKLMNAYPSYISPTGPLPAHLLGDM

WGRFWTNLYSLTVPFGQKPNIDVTDAMVDQAWDAQRIFKEAEKFF

VSVGLPNMTQGFWENSMLTDPGNGQKVVCYPTAWDLGKGDFRILM

CTKVTMDDFLTAHHEMGHIQYDMAYLAQPFLLRNGANEGFHEAVG

EIMSLSAATPKHLKSIGLLSPDFQEDNETEINFLLKQALTIVGTL

PFTYMLERWRWMVFKGEIPKDQWMKKWWEMKREIVGVVEPVPHDE

TYCDPASLFHVSNDYSFIRYYTRTLYQFQFQEALCQAAKHEGPLH

KCDISNSTEAGQKLFNMLRLGKSEPWTLALENVVGAKNMNVRPLL

NYFEPLFTWLKDQNKNSFVGWSTDWSPYADQSIKIRLSLKSALGD

KAYEWNDNEMYLFRSSVAYVMRQYFSKVKNQMIGFGEEDVRVANL

KPRISFNFFLTAPKNVSDITPRTEVEKAIRMSRSRINDCFRLNDN

SLEFLGIQPTLGPPNQPPVSDKTHTCPPCPAPEAAGGPSVFLFPP

KPKDTLMISRTPEVTCVVVDVSHEDPEVKFNWYVDGVEVHNAKTK

PREEQYNSTYRVVSVLTVLHQDWLNGKEYKCKVSNKALPAPIEKT

ISKAKGQPREPQVYTLPPSREEMTKNQVSLTCLVKGFYPSDIAVE

WESNGQPENNYKTTPPVLDSDGSFFLYSKLTVDKSRWQQGNVFSC

SVLHEALHSHYTQKSLSPGK- (K74C/S106C/A342V/I622L/I695T/A714C no intron)
SEQ ID NO: 67 gagctcacttagtgaactgtcagatcacctggagacacatccaca ctgttttgacctccatagcagacaccaggaccaatccagcctcaa gacagattcaggaactgaaaaaccagaaagttaacaggtaagttt aaagctcagggcaagactgggcctttgcctgggtctggtggtggt gcaaatcaaagaactgctcctcacatttttttccttttcttccag gcctgtaaggaagtgttacttctactctaaaagctgaggaattgt agagctagcagccaccatgagcagcagtagctggctgctcctgag ccttgtggctgtaacagcagcccagagcaccattgaagagcaggc -continued caagaccttcctggacaagttcaaccatgaagctgaagacctgtt ctaccagagcagcctggccagctggaactacaacaccaacatcac agaggagaatgtgcagaacatgaacaatgctggagacaagtggag tgcattcctgtgtgagcagagcacactggcccagatgtacccact gcaggagatccagaacctgacagtgaagctgcagctgcaggcact gcagcagaatggcagctgtgtactgtctgaagacaagagcaagag actgaatacaattctgaacacaatgagcacaatctacagcacagg caaagtgtgcaatccagacaatcctcaggagtgcctgctgctgga acctggcctgaatgagatcatggccaatagcctggactacaatga aagactgtgggcctgggaaagctggagaagtgaagtgggcaagca gctgagaccactgtatgaggaatatgtagtgctgaagaatgagat ggccagagccaaccactatgaagactatggagactactggagagg agactatgaagtcaatggagtagatggctatgactacagtagagg ccagctcattgaagatgtagagcataccctttgaagaaatcaagcc actgtatgagcacctccatgcatatgtaagagccaagctgatgaa tgcatatccaagctacattagcccaattggatgcctgcctgcaca cctgctgggagacatgtggggaagattctggacaaacctgtactc cctgactgtgccatttggccaaaaacccaacattgatgtcactga tgccatggtagaccaggcctgggtgcacagagaatcttcaaaga agctgaaaaattctttgtatcagtgggcctgccaaacatgacaca aggattctgggaaaatagtatgctgacagatccaggcaatgtcca gaaagtagtctgccatccaacagcatgggatctgggaaaaggaga cttcagaatcctgatgtgcaccaaagtgaccatggatgacttcct gactgcacaccatgagatgggacacatccagtatgacatggcata tgcagcccagccattcctgctgagaaatggagccaatgaaggctt ccatgaagcagtgggagagatcatgagcctgagtgcagccacacc caagcacctgaagagcattggcctgctgagccctgacttccagga agacaatgagactgagatcaacttcctgctgaagcaagcactgac cattgtaggcacactgccattcacctacatgctggagaaatggag atggatggtgttcaaaggagagatcccaaaggatcagtggatgaa gaaatggtgggaaatgaaaagagaaattgtaggagtagtagagcc tgtcccacatgatgagacctactgtgatcctgcaagcctgttcca tgtgtccaatgactacagcttcattagatactacactagaaccct gtaccagttccaattccaagaagcactgtgccaggcagccaagca tgaaggaccactgcacaaatgtgacatctccaatagcacagaagc aggccagaagctgttcaacatgctgagactgggcaagagtgagcc atggaccctggcactggagaatgtagtaggagcaaaaaacatgaa tgtaagaccactgctgaactactttgaaccactgttcacatggct gaaagaccaaaacaagaattcatttgtaggatggagcacagactg gagcccatatgctgatcaaagcatcaaagtcagactgtcactaaa atcagcactaggagacaaagcctatgaatggaatgacaatgagat -continued gtacctgtttagaagctctgtagcctatgccatgagacaatactt cctgaaagtcaaaaaccagatgatcctgtttggagaagaagatgt cagagtagccaatctgaagcctagaatcagcttcaacttctttgt aactgcacctaagaatgtatcagacatcactccaagaacagaagt agaaaaagccatcagaatgagcgagaagcagaatcaatgactgctt cagactgaatgacaacagcctggagttcctgggaatccagcctac actgggaccaccaaaccaaccaccagtagaatgtccaccatgtcc agcaccaccagtagcaggaccaagtgtattcctattcccaccaaa gccasaagacacactaatgatatctagaacacctgaagtgacctg tgtagtagtagatgtatcccatgaagaccctgaagtccaattcaa ttggtatgtggatggagtggaagtacacaatgccaagaccaaacc aagagaagagcaattcaatagcacattcagagtagtatctgtact cactgtagtgcaccaagactggctcaatggcaaagaatacaaatg caaagtgtccaacaaaggactccctgcaccaattgaaaagactat ctccaagaccaaaggacaaccaagagagccacaagtctacacact gccaccaagtagagaagagatgaccaagaaccaagtatcactgac atgccttgtcaaaggattctaccctagtgacattagtgtagaatg ggaaagtaatggacaacctgaaaacaactacaagacaacaccacc aatgctggatagtgatggcagcttcttcctgtactcaaaactgac tgtagacaaaagtagatggcaacaaggaaatgtgtttagctgttc tgtactgcatgaagcactgcacagccactacacacaaaaaagcct gagtctgagccctggcaagtgataggatccagatctgctgtgcct tctagttgcagccatctgttgtttgccctcccccgtgccttcct tgaccctggaagtgccactcccactgtcctttcctaataaaagag gaaattgcatcgcattgtctgagtagtgtcattctattctggggg gtggggtgggg (K74C/S106C/A342V/I622L/I695T plus intron)

SEQ ID NO: 68 gagctcacttagtgaactgtcagatcacctggagacacatccaca ctgtttgacctccatagcagacaccaggaccaatccagcctcaa gacagattcaggaactgaaaaaccagaaagttaacaggtaagttt aaagctcagggcaagactgggcctttgcctgggtctggtggtggt gcaaatcaaagaactgctcctcacattttttttcctttttcttccag gcctgtaaggaagtgttacttctactctaaaagctgaggaattgt agagctagcagccaccatgagcagcagtagctggctgctcctgag ccttgtggctgtaacagcagcccagagcaccattgaagagcaggc caagaccttcctggacaagttcaaccatgaagctgaagacctgtt ctaccagagcagcctggccagctggaactacaacaccaacatcac agaggagaatgtgcagaacatgaacaatgctggagacaagtggag tgcattcctgtgtgagcagagcacactggcccagatgtacccact gcaggagatccagaacctgacagtgaagctgcagctgcaggcact -continued gcagcagaatggcagctgtgcactgtctgaagacaagagcaagag actgaatacaattctgaacacaatgagcacaatctacagcacagg caaagtgtgcaatccagacaatcctcaggagtgcctgctgctgga acctggcctgaatgagatcatggccaatagcctggactacaatga aagactgtgggcctgggaaagctggagaagtgaagtgggcaagca gctgagaccactgtatgaggaatatgtagtgctgaagaatgagat ggccagagccaaccactatgaagactatggagactactggagagg agactatgaagtcaatggagtagatggctatgactacagtagagg ccagctcattgaagatgtagagcataccctttgaagaaatcaagcc actgtatgagcactccatgcatatgtaagagccaagctgatgaa tgcatatccaagctacattagcccaattggatgcctgcctgcaca cctgctgggagacatgtggggaagattctggacaaacctgtactc cctgactgtgccatttggccaaaaacccaacattgatgtcactga tgccatggtagaccaggcctgggatgcacagagaatcttcaaaga agctgaaaaattctttgtatcagtgggcctgccaaacatgacaca aggattctgggaaatagtatgctgacagatccaggcaatgtcca gaaagtagtctgccatccaacagcatgggatctgggaaaaggaga cttcagaatcctgatgtgcaccaaagtgaccatggatgacttcct gactgcacaccatgagatgggacacatccagtatgacatggcata tgcagcccagccattcctgctgagaaatggagccaatgaaggctt ccatgaagcagtgggagagatcatgagcctgagtgcagccacacc caagcacctgaagagcattggcctgctgagccctgacttccagga agacaatgagactgagatcaacttcctgctgaagcaagcactgac cattgtaggcacactgccattcacctacatgctggagaaatggag atggatggtgttcaaaggagagatcccaaaggatcagtggatgaa gaaatggtgggaaatgaaaagagaaattgtaggagtagtagagcc tgtcccacatgatgagacctactgtgatcctgcaagcctgttcca tgtgtccaatgactacagcttcattagatactacactagaaccct gtaccagttccaattccaagaagcactgtgccaggcagccaagca tgaaggaccactgcacaaatgtgacatctccaatagcacagaagc aggccagaagctgttcaacatgctgagactgggcaagagtgagcc atggaccctggcactggagaatgtagtaggagcaaaaaacatgaa tgtaagaccactgctgaactactttgaaccactgttcacatggct gaaagaccaaaacaagaattcatttgtaggatggagcacagactg gagcccatatgctgatcaaagcatcaaggtaagttgaaagctcag ggggagactgggcctttgtctggggctcccttggagcctacctag actcagctggctctccaggctttgcctgaccctgcttgctcaact ctagttaactgtggagggcagtgtagtctgagcagtacttgttgc tgctggggggggccaccagacataatagctgacagactaacagact gttcctttcctttttctttcctgcaggtaagactgtcactaaaa tcagcactaggagacaaagcctatgaatggaatgacaatgagatg -continued tacctgtttagaagctctgtagcctatgccatgagacaatacttc ctgaaagtcaaaaaccagatgatcctgtttggagaagaagatgtc agagtagccaatctgaagcctagaatcagcttcaacttctttgta actgcacctaagaatgtatcagacatcactccaagaacagaagta gaaaaagccatcagaatgagcagaagcagaatcaatgactgcttc agactgaatgacaacagcctggagttcctgggaatccagcctaca ctgggaccaccaaaccaaccaccagtagaatgtccaccatgtcca gcaccaccagtagcaggaccaagtgtattcctattcccaccaaag ccaaaagacacactaatgatatctagaacacctgaagtgacctgt gtagtagtagatgtatcccatgaagaccctgaagtccaattcaat tggtatgtggatggagtggaagtacacaatgccaagaccaaacca agagaagagcaattcaatagcacattcagagtagtatctgtactc actgtagtgcaccaagactggctcaatggcaaagaatacaaatgc aaagtgtccaacaaaggactccctgcaccaattgaaaagactatc tccaagaccaaaggacaaccaagagagccacaagtctacacactg ccaccaagtagagaagagatgaccaagaaccaagtatcactgaca tgccttgtcaaaggattctaccctagtgacattagtgtagaatgg gaaagtaatggacaacctgaaaacaactacaagacaacaccacca atgctggatagtgatggcagcttcttcctgtactcaaaactgact gtagacaaaagtagatggcaacaaggaaatgtgtttagctgttct gtactgcatgaagcactgcacagccactacacacaaaaaagcctg agtctgagccctggcaagtgataggatccagatctgctgtgcctt ctagttgcagccatctgttgtttgcccctcccccgtgccttcctt gaccctggaagtgccactcccactgtcctttcctaataaaagagg aaattgcatcgcattgtctgagtagtgtcattctattctggggggg tggggtgggg Amino acid sequence of
A25V/S43C/G66C/K74C/N90D/S106C/S128C/I259T/
C261P/V339G/A342V/V343C/
H345Y/C498M/I695T/A714C ACE2 mutein
fused directly to an
IgG2 Fc with directly-fused ACE2 leader

SEQ ID NO: 125

MSSSSWLLLSLVAVTAA0ST1EEQVKTFLDKFNHEAEDLFYQCSL

ASWNYNTNITEENVQNMNNACDKWSAFLCEQSTLAQMYPLQEIQD

LTVKLQLQALQQNGSCVLSEDKSKRLNTILNTMSTIYCTGKVCNP

DNPQECLLLEPGLNEIMANSLDYNERLWAWESWRSEVGKQLRPLY

EEYVVLKNEMARANHYEDYGDYWRGDYEVNGVDGYDYSRGQLIED

VEHTFEEIKPLYEHLHAYVRAKLMNAYPSYISPTGPLPAHLLGDM

WGRFWTNLYSLTVPFGQKPNIDVTDAMVDQAWDAQRIFKEAEKFF

VSVGLPNMTQGFWENSMLTDPGNGQKVCCYPTAWDLGKGDFRILM

CTKVTMDDFLTAHHEMGHIQYDMAYAAQPFLLRNGANEGFHEAVG

EIMSLSAATPKHLKSIGLLSPDFQEDNETEINFLLKQALTIVGTL

PFTYMLEKWRWMVFKGEIPKDQWMKKWWEMKREIVGVVEPVPHDE

-continued

TYMDPASLFHVSNDYSFIRYYTRTLYQFQFQEALCQAAKHEGPLH

KCDISNSTEAGQKLFNMLRLGKSEPWTLALENVVGAKNMNVRPLL

NYFEPLFTWLKDQNKNSFVGWSTDWSPYADQSIKVRISLKSALGD

KAYEWNDNEMYLFRSSVAYAMRQYFLKVKNQMILFGEEDVRVANL

KPRISFNFFVTAPKNVSDITPRTEVEKAIRMSRSRINDCFRLNDN

SLEFLGIQPTLGPPNQPPVECPPCPAPPVAGPSVFLFPPKPKDTL

MISRTPEVTCVVVDVSHEDPEVQFNWYVDGVEVHNAKTKPREEQF

NSTFRVVSVLTVVHQDWLNGKEYKCKVSNKGLPAPIEKTISKTKG

QPREPQVYTLPPSREEMTKNQVSLTCLVKGFYPSDISVEWESNGQ

PENNYKTTPPMLDSDGSFFLYSKLTVDKSRWQQGNVFSCSVLHEA

LHSHYTQKSLSLSPGK--

Internal intron-containing nucleic acid
sequence of
A25V/S43C/G66C/K74C/N90D/S106C/S128C/I259T/
C261P/V339G/A342V/V343C/
H345Y/C498M/I695T/A714C ACE2 mutein
fused directly to an
IgG2 Ec with directly-fused ACE2 leader
SEQ ID NO: 126
gagctcacttagtgaactgtcagatcacctggagacacatccaca ctgttttgacctccatagcagacaccaggaccaatccagcctcaa gacagattcaggaactgaaaaaccagaaagttaacaggtaagttt aaagctcagggcaagactgggcctttgcctgggtctggtggtggt gcaaatcaaagaactgctcctcacattttttttccttttcttccag gcctgtaaggaagtgttacttctactctaaaagctgaggaattgt agagctagcagccaccatgtcaagctctagctggctcctgctcag ccttgtagctgtaacagcagcacagagcaccattgaagaacaagt caaaacattcctggacaaattcaaccatgaagctgaagacctgtt ctaccaatgctcactggcaagctggaactacaacacaaacatcac agaagagaatgtccaaaacatgaacaatgcatgtgacaaatggag tgcattcctctgtgaacaaagcacactggcccaaatgtacccact ccaagaaatccagacctgacagtcaagctgcagctgcaggcact gcagcagaatggaagctgtgtactgagtgaagacaaatccaaaag actaaacacaatactaaacacaatgagcacaatctactgcacagg aaaagtatgcaacccagacaatccacaagaatgcctgctgctgga accaggactcaatgaaatcatggccaactcactagactacaatga aagactctgggcatgggaaagctggagatcagaagtaggcaaaca actcagaccactctatgaagaatatgtagtcctcaaaaatgaaat ggcaagagcaaaccactatgaagactatggagactactggagagg agactatgaagtaaatggagtagatggctatgactactcaagagg acaactaatagaagatgtagaacacacatttgaagaaatcaaacc actctatgaacacctccatgcatatgtaagagcaaaactcatgaa tgcctacccatcatacatcagcccaacaggaccactaccagcaca cctactaggagacatgtggggaagattctggacaaacctgtacag -continued
cctgacagtaccatttggacagaaaccaaacatagatgtcacaga tgcaatggtagaccaagcctgggatgcacagagaatattcaaaga agcagaaaaattctttgtatctgtgggactccccaacatgacaca aggattctgggaaaactccatgctgacagacccaggaaatggcca gaaagtatgctgctacccaacagcctgggacctaggcaaaggaga cttcagaatcctgatgtgcaccaaagtcacaatggatgacttcct gacagcccaccatgaaatgggccacatccaatatgacatggcata tgcagcacaaccattcctactaagaaatggagccaatgaaggatt ccatgaagcagtaggagaaatcatgtcactgagtgcagccacacc caagcacctgaaaagcattggactgctgagcccagacttccaaga agacaatgaaacagaaataaacttcctactaaaacaagcactgac aattgtaggaaccctgccattcacctacatgctggaaaaatggag atggatggtcttcaaaggagaaatcccaaaagaccagtggatgaa aaaatggtgggaaatgaaaagagaaatagtaggagtagtagaacc agtaccacatgatgaaacatacatggacccagcatcactattcca tgtatcaaatgactacagcttcataagatactacacaagaacact gtaccaattccaattccaagaagcactatgccaagcagccaagca tgaaggcccactgcacaaatgtgacatcagcaactccacagaagc aggacagaagctcttcaacatgctgagactgggaaaatcagaacc atggaccctggcactggaaaatgtagtaggagccaagaacatgaa tgtaagaccactcctcaactactttgaaccactcttcacatggct caaagaccaaaacaagaattcatttgtaggatggagcacagactg gagcccatatgctgatcaaagcatcaaggtaagttgaaagctcag ggggagactgggcctttgtctggggctcccttggagcctacctag actcagctggctctccaggctttgcctgaccctgcttgctcaact ctagttaactgtggagggcagtgtagtctgagcagtacttgttgc tgctggggggggccaccagacataatagctgacagactaacagact gttcctttcctttttttctttcctgcaggtaagaatctcactaaaa tcagcactaggagacaaagcctatgaatggaatgacaatgagatg tacctgtttagaagctctgtagcctatgccatgagacaatacttc ctgaaagtcaaaaaccagatgatcctgtttggagaagaagatgtc agagtagccaatctgaagcctagaatcagcttcaacttctttgta actgcacctaagaatgtatcagacatcactccaagaacagaagta gaaaaagccatcagaatgagcagaagcagaatcaatgactgcttc agactgaatgacaacagcctggagttcctgggaatccagcctaca ctgggaccaccaaaccaaccaccagtagaatgtccaccatgtcca gcaccaccagtagcaggaccaagtgtattcctattcccaccaaag ccaaaagacacactaatgatatctagaacacctgaagtgacctgt gtagtagtagatgtatcccatgaagaccctgaagtccaattcaat tggtatgtggatggagtggaagtacacaatgccaagaccaaacca agagaagagcaattcaatagcacattcagagtagtatctgtactc -continued

```
actgtagtgcaccaagactggctcaatggcaaagaatacaaatgc aaagtgtccaacaaaggactccctgcaccaattgaaaagactatc tccaagaccaaaggacaaccaagagagccacaagtctacacactg ccaccaagtagagaagagatgaccaagaaccaagtatcactgaca tgccttgtcaaaggattctaccctagtgacattagtgtagaatgg gaaagtaatggacaacctgaaaacaactacaagacaacaccacca atgctggatagtgatggcagcttcttcctgtactcaaaactgact gtagacaaaagtagatggcaacaaggaaatgtgtttagctgttct gtactgcatgaagcactgcacagccactacacacaaaaaagcctg agtctgagccctggcaagtgataggatccagatctgctgtgcctt ctagttgcagccatctgttgtttgcccctcccccgtgccttcctt gaccctggaagtgccactcccactgtcctttcctaataaaagagg aaattgcatcgcattgtctgagtagtgtcattctattctgggggg tggggtgggg
```

Amino acid sequence of
S43C/G66C/K74C/N90D/S106C/S128C/I259T/C261P/
V339G/A342V/V343C/
H345Y/C498M/I695T/A714C ACE2 mute in fused
directly to an IgG2
Fc with directly-fused ACE2 leader

SEQ ID NO: 127

```
MSSSSWLLLSLVAVTAAQSTIEEQAKTFLDKFNHEAEDLFYQCSL

ASWNYNTNITEENVQNMNNACDKWSAFLCEQSTLAQMYPLQEIQD

LTVKLQLQALQQNGSCVLSEDKSKRLNTILNTMSTIYCTGKVCNP

DNPQECLLLEPGLNEIMANSLDYNERLWAWESWRSEVGKQLRPLY

EEYVVLKNEMARANHYEDYGDYWRGDYEVNGVDGYDYSRGQLIED

VEHTFEEIKPLYEHLHAYVRAKLMNAYPSYISPTGPLPAHLLGDM

WGRFWTNLYSLTVPFGQKPNIDVTDAMVDQAWDAQRIFKEAEKFF

VSVGLPNMTQGFWENSMLTDPGNGQKVCCYPTAWDLGKGDFRILM

CTKVTMDDFLTAHHEMGHIQYDMAYAAQPFLLRNGANEGFHEAVG

EIMSLSAATPKHLKSIGLLSPDFQEDNETEINFLLKQALTIVGTL

PFTYMLEKWRWMVFKGEIPKDQWMKKWWEMKREIVGVVEPVPHDE

TYMDPASLFHVSNDYSFIRYYTRTLYQFQFQEALCQAAKHEGPLH

KCDISNSTEAGQKLFNMLRLGKSEPWTLALENVVGAKNMNVRPLL

NYFEPLFTWLKDQNKNSFVGWSTDWSPYADQSIKVRISLKSALGD

KAYEWNDNEMYLFRSSVAYAMRQYFLKVKNQMILFGEEDVRVANL

KPRISFNFFVTAPKNVSDITPRTEVEKAIRMSRSRINDCFRLNDN

SLEFLGIQPTLGPPNQPPVECPPCPAPPVAGPSVFLFPPKPKDTL

MISRTPEVTCVVVDVSHEDPEVQFNWYVDGVEVHNAKTKPREEQF

NSTFRVVSVLTVVHQDWLNGKEYKCKVSNKGLPAPIEKTISKTKG

QPREPQVYTLPPSREEMTKNQVSLTCLVKGFYPSDISVEWESNGQ

PENNYKTTPPMLDSDGSFFLYSKLTVDKSRWQQGNVFSCSVLHEA

LHSHYTQKSLSLSPGK--
```

-continued

Internal intron-containing nucleic acid,
sequence of
S43C/G66C/K74C/N90D/S106C/S128C/I259T/
C261P/V339G/A342V/V343C/
H345Y/C498M/I695T/A714C ACE2 mutein
fused directly to an IgG2
Fc with directly-fused ACE2 leader

SEQ ID NO: 128

```
gagctcacttagtgaactgtcagatcacctggagacacatccaca ctgttttgacctccatagcagacaccaggaccaatccagcctcaa gacagattcaggaactgaaaaaccagaaagttaacaggtaagttt aaagctcagggcaagactgggcctttgcctgggtctggtggtggt gcaaatcaaagaactgctcctcacatttttttccttttcttccag gcctgtaaggaagtgttacttctactctaaaagctgaggaattgt agagctagcagccaccatgtcaagctctagctggctcctgctcag ccttgtagctgtaacagcagcacagagcaccattgaagaacaagc caaaacattcctggacaaattcaaccatgaagctgaagacctgtt ctaccaatgctcactggcaagctggaactacaacacaaacatcac agaagagaatgtccaaaacatgaacaatgcatgtgacaaatggag tgcattcctctgtgaacaaagcacactggcccaaatgtacccact ccaagaaatccaagacctgacagtcaagctgcagctgcaggcact gcagcagaatggaagctgtgtactgagtgaagacaaatccaaaag actaaacacaatactaaacacaatgagcacaatctactgcacagg aaaagtatgcaacccagacaatccacaagaatgcctgctgctgga accaggactcaatgaaatcatggccaactcactagactacaatga aagactctgggcatgggaaagctggagatcagaagtaggcaaaca actcagaccactctatgaagaatatgtagtcctcaaaaatgaaat ggcaagagcaaaccactatgaagactatggagactactggagagg agact&tgaagtaaatggagtagatggctatgactactcaagagg acaactaatagaagatgtagaacacacatttgaagaaatcaaacc actctatgaacacctccatgcatatgtaagagcaaaactcatgaa tgcctaccatcatacatcagcccaacaggaccactaccagcaca cctactaggagacatgtggggaagattctggacaaacctgtacag cctgacagtaccatttggacagaaaccaaacatagatgtcacaga tgcaatggtagaccaagcctgggatgcacagagaatattcaaaga agcagaaaaattctttgtatctgtgggactccccaacatgacaca aggattctgggaaaactccatgctgacagacccaggaaatggcca gaaagtatgctgctacccaacagcctgggacctaggcaaaggaga cttcagaatcctgatgtgcaccaaagtcacaatggatgacttcct gacagccaccatgaaatgggccacatccaatatgacatggcata tgcagcacaaccattcctactaagaaatggagccaatgaaggatt ccatgaagcagtaggagaaatcatgtcactgagtgcagccacacc caagcacctgaaaagcattggactgctgagcccagacttccaaga agacaatgaaacagaaataaacttcctactaaaacaagcactgac
```

-continued

```
aattgtaggaaccctgccattcacctacatgctggaaaaatggag atggatggtcttcaaaggagaaatcccaaaagaccagtggatgaa aaaatggtgggaaatgaaaagagaaatagtaggagtagtagaacc agtaccacatgatgaaacatacatggacccagcatcactattcca tgtatcaaatgactacagcttcataagatactacacaagaacact gtaccaattccaattccaagaagcactatgccaagcagccaagca tgaaggcccactgcacaaatgtgacatcagcaactccacagaagc aggacagaagctcttcaacatgctgagactgggaaaatcagaacc atggaccctggcactggaaaatgtagtaggagccaagaacatgaa tgtaagaccactcctcaactactttgaaccactcttcacatggct caaagaccaaaacaagaattcatttgtaggatggagcacagactg gagcccatatgctgatcaaagcatcaaggtaagttgaaagctcag ggggagactgggcctttgtctgggggctcccttggagcctacctag actcagctggctctccaggctttgcctgaccctgcttgctcaact ctagttaactgtggagggcagtgtagtctgagcagtacttgttgc tgctggggggggccaccagacataatagctgacagactaacagact gttcctttcctttttctttcctgcaggtaagaatctcactaaaa tcagcactaggagacaaagcctatgaatggaatgacaatgagatg tacctgtttagaagctctgcagcctatgccatgagacaatacttc ctgaaagtcaaaaaccagatgatcctgtttggagaagaagatgtc agagtagccaatctgaagcctagaatcagcttcaacttctttgta actgcacctaagaatgtatcagacatcactccaagaacagaagta gaaaaagccatcagaatgagcagaagcagaatcaatgactgcttc agactgaatgacaacagcctggagttcctgggaatccagcctaca ctgggaccaccaaaccaaccaccagtagaatgtccaccatgtcca gcaccaccagtagcaggaccaagtgtattcctattcccaccaaag ccaaaagacacactaatgatatctagaacacctgaagtgacctgt gtagtagtagatgtatcccatgaagaccctgaagtccaattcaat tggtatgtggatggagtggaagtacacaatgccaagaccaaacca agagaagagcaattcaatagcacattcagagtagtatctgtactc actgtagtgtcaccaagactggctcaatggcaaagaatacaaatgc aaagtgtccaacaaaggactccctgcaccaattgaaaagactatc tccaagaccaaaggacaaccaagagagccacaagtctacacactg ccaccaagtagaagagatgaccaagaaccaagtatcactgaca tgccttgtcaaaggattctaccctagtgacattagtgtagaatgg gaaagtaatggacaacctgaaaacaactacaagacaacaccacca atgctggatagtgatggcagcttcttcctgtactcaaaactgact gtagacaaagtagatggcaacaaggaaatgtgtttagctgttct gtactgcatgaagcactgcacagccactacacacaaaaaagcctg agtctgagccctggcaagtgataggatccagatctgctgtgcctt ctagttgcagccatctgttgtgtttgcccctcccccgtgccttcctt
```

-continued

```
gaccctggaagtgccactcccactgtcctttcctaataaaagagg aaattgcatcgcattgtctgagtagtgtcattctattctgggggg tggggtgggg
```

Amino acid sequence of
A25V/S43C/G66C/N90D/I259T/C261P/V339G/
A342V/C498M/I695T/A714C
catalytically active ACE2 mutein fused
directly to an IgG2 Fc
with directly-fused ACE2 leader

SEQ ID NO: 129

```
MSSSSWLLLSLVAVTAAQSTIEEQVKTFLDKFNHEAEDLFYQCSL

ASWNYNTNITEENVQNMNNACDKWSAFLKEQSTLAQMYPLQEIQD

LTVKLQLQALQQNGSSVLSEDKSKRLNTILNTMSTIYSTGKVCNP

DNPQECLLLEPGLNEIMANSLDYNERLWAWESWRSEVGKQLRPLY

EEYVVLKNEMARANHYEDYGDYWRGDYEVNGVDGYDYSRGQLIED

VEHTFEEIKPLYEHLHAYVRAKLMNAYPSYLSPTGPLPAHLLGDM

WGRHWTNLYSLTVPEGQKPNIDVTDAMVDQAWDAQRIFKEAEKFF

VSVGLPNMTQGFWENSMLTDPGNGQKVVCHPTAWDLGKGDFRILM

CTKVTMDDFLTAHHEMGHIQYDMAYAAQPFLLRNGANEGFHEAVG

EIMSLSAATPKHLKSIGLLSPDFQEDNETEINFLLKQALTIVGTL

PFTYMLEKWRWMVFKGEIPKDQWMKKWWEMKREIVGVVEPVPHDE

TYMDPASLFHVSNDYSFIRYYTRTLYQFQFQEALCQAAKHEGPLH

KCDISNSTEAGQKLFNMLRLGKSEPWTLALENVVGAKNMNVRPLL

NYFEPLETWLKDQNKNSFVGWSTDWSPYADQSIKVRISLKSALGD

KAYEWNDNEMYLFRSSVAYAMRQYFLKVKNQMILFGEEDVRVANL

KPRISFNFFVTAPKNVSDITPRTEVEKAIRMSRSRINDCFRLNDN

SLEFLGIQPTLGPPNQPPVECPPCPAPPVAGPSVFLFPPKPKDTL

MISRTPEVTCVVVDVSHEDPEVQFNWYVDGVEVHNAKTKPREEQF

NSTFRVVSVLTVVHQDWLNGKEYKCKVSNKGLPAPIEKTISKTKG

QPREPQVYTLPPSREEMTKNQVSLTCLVKGFYPSDISVEWESNGQ

PENNYKTTPPMLDSDGSFFLYSKLTVDKSRWQQGNVFSCSVLHEA

LHSHYTQKSLSLSPGK--
```

Amino acid sequence of
S43C/G66C/N90D/I259T/C261P/V339G/
A342V/C498M/I695T/A714C
catalytically active ACE2 mutein fused,
directly to an IgG2 Fc
with directly-fused ACE2 leader

SEQ ID NO: 130

```
MSSSSWLLLSLVAVTAAQSTIEEQAKTFLDKFNHEAEDLFYQCSL

ASWNYNTNITEENVQNMNNACDKWSAFLKEQSTLAQMYPLQEIQD

LTVKLQLQALQQNGSSVLSEDKSKRLNTILNTMSTIYSTGKVCNP

DNPQECLLLEPGLNEIMANSLDYNERLWAWESWRSEVGKQLRPLY

EEYVVLKNEMARANHYEDYGDYWRGDYEVNGVDGYDYSRGQLIED

VEHTFEEIKPLYEHLHAYVRAKLMNAYPSYISPTGPLPAHLLGDM

WGRFWTNLYSLTVPFGQKPNIDVTDAMVDQAWDAQRIFKEAEKFF

VSVGLPNMTQGFWENSMLTDPGNGQKVVCHPTAWDLGKGDFRILM
```

-continued

```
CTKVTMDDFLTAHHEMGHIQYDMAYAAQPFLLRNGANEGFHEAVG

EIMSLSAATPKHLKSIGLLSPDFQEDNETEINFLLKQALTLVGTL

PHTYMLEKWRWMVFKGELPKDQWMKKWWEMKRELVGVVEPVPHDE

TYMDPASLFHVSNDYSFTRYYTRTLYQFQFQEALCQAAKHEGPLH

KCDISNSTEAGQKLFNMLRLGKSEPWTLALENVVGAKNMNVRPLL

NYFEPLFTWLKDQNKNSFVGWSTDWSPYADQSIKVRISLKSALGD

KAYEWNDNEMYLFRSSVAYAMRQYFLKVKNQMILFGEEDVRVANL
```

-continued

```
KPRISFNFFVTAPKNVSDITPRTEVEKAIRMSRSRTNDCFRLNDN

SLEFLGTQPTLGPPNQPPVECPPCPAPPVAGPSVFLFPPKPKDTL

MISRTPEVTCVVVDVSHEDPEVQFNWYVDGVEVHNAKTKPREEQF

NSTFRVVSVLTVVHQDWLNGKEYKCKVSNKGLPAPIEKTISKTKG

QPREPQVYTLPPSREEMTKNQVSLTCLVKGFYPSDISVEWESNGQ

PENNYKTTPPMLDSDGSFFLYSKLTVDKSRWQQGNVFSCSVLHEA

LHSHYTQKSLSLSPGK--
```

SEQUENCE LISTING (130 sequences)

SEQ ID NO: 1 - protein, 805 aa, Homo sapiens [sequence omitted]

SEQ ID NO: 2 - protein, 7 aa, Artificial Sequence
  Description of Artificial Sequence: Synthetic peptide
CPAPELL

SEQ ID NO: 3 - protein, 38 aa, Artificial Sequence
  Description of Artificial Sequence: Synthetic polypeptide
PVPSTPPTPSPSTPPTPSPSCCHPRLSLHRPALEDLLL

SEQ ID NO: 4 - protein, 25 aa, Artificial Sequence
  Description of Artificial Sequence: Synthetic peptide
RVPPPPPCCHPRLSLHRPALEDLLL

SEQ ID NO: 5 - protein, 21 aa, Artificial Sequence
  Description of Artificial Sequence: Synthetic peptide
VEPKSCDKTHTCPPCPAPELL

SEQ ID NO: 6 - protein, 22 aa, Artificial Sequence
  Description of Artificial Sequence: Synthetic peptide
VDKTVERKCCVECPPCPAPPVA

SEQ ID NO: 7 - protein, 71 aa, Artificial Sequence
  Description of Artificial Sequence: Synthetic polypeptide
DKRVELKTPLGDTTHTCPRCPEPKSCDTPPPCPRCPEPKSCDTPPPCPRCPEPKSCDTPPPCPRCPAPELL

SEQ ID NO: 8 - protein, 22 aa, Artificial Sequence
  Description of Artificial Sequence: Synthetic peptide
VDKRVESKYGPPCPSCPAPEFL

SEQ ID NO: 9 - protein, 6 aa, Artificial Sequence
  Description of Artificial Sequence: Synthetic peptide
CPAPPV

SEQ ID NO: 10 - protein, 7 aa, Artificial Sequence
  Description of Artificial Sequence: Synthetic peptide
CPAPEFL

SEQ ID NO: 11 - protein, 7 aa, Artificial Sequence
  Description of Artificial Sequence: Synthetic peptide
CPAPEAA

SEQ ID NO: 12 - protein, 15 aa, Artificial Sequence
  Description of Artificial Sequence: Synthetic peptide
YADQSSDKTHTCPPC

SEQ ID NO: 13 - protein, 12 aa, Artificial Sequence
  Description of Artificial Sequence: Synthetic peptide
YADQSSVECPPC

SEQ ID NO: 14 - protein, 23 aa, Artificial Sequence
  Description of Artificial Sequence: Synthetic peptide
YADQSPSTPPTPSPSCCVECPPC

SEQ ID NO: 15 - protein, 12 aa, Artificial Sequence
  Description of Artificial Sequence: Synthetic peptide
PPNQPPVECPPC

SEQ ID NO: 16 - protein, 4 aa, Artificial Sequence
  Description of Artificial Sequence: Synthetic peptide
NNSS

SEQ ID NO: 17 - protein, 4 aa, Artificial Sequence
  Description of Artificial Sequence: Synthetic peptide
NNST

SEQ ID NO: 18 - protein, 4 aa, Artificial Sequence
  Description of Artificial Sequence: Synthetic peptide
NNTS

SEQ ID NO: 19 - protein, 4 aa, Artificial Sequence
  Description of Artificial Sequence: Synthetic peptide
NNTT

SEQ ID NO: 20 - protein, 330 aa, Artificial Sequence [sequence omitted]

SEQ ID NO: 21 - protein, 326 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGK

SEQ ID NO: 22 - protein, 377 aa, Artificial Sequence
  Description of Artificial Sequence: Synthetic polypeptide
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 23 - protein, 327 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 24 - protein, 384 aa, Artificial Sequence
  Description of Artificial Sequence: Synthetic polypeptide
APTKAPDVFPIISGCRHPKDNSPVVLACLITGYHPTSVTVTWYMGTQSQPQRTFPEIQRRDSYYMTSSQLSTPLQQWRQGEYKCVVQHTASKSKKEIFRWPESPKAQASSVPTAQPQAEGSLAKATTAPATTRNTGRGGEEKKKEKEKEEQEERETKTPECPSHTQPLGVYLLTPAVQDLWLRDKATFTCFVVGSDLKDAHLTWEVAGKVPTGGVEEGLLERHSNGSQSQHSRLTLPRSLWNAGTSVTCTLNHPSLPPQRLMALREPAAQAPVKLSLNLLASSDPPEAASWLLCEVSGFSPPNILLMWLEDQREVNTSGFAPARPPPQPRSTTFWAWSVLRVPAPPSPQPATYTCVVSHEDSRTLLNASRSLEVSYVTDHGPMK

SEQ ID NO: 25 - protein, 453 aa, Artificial Sequence
  Description of Artificial Sequence: Synthetic polypeptide
GSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPVIAELPPKVSVFVPPRDGFFGNPRKSKLICQATGFSPRQIQVSWLREGKQVGSGVTTDQVQAEAKESGPTTYKVTSTLTIKESDWLGQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLPSPLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 26 - protein, 353 aa, Artificial Sequence
  Description of Artificial Sequence: Synthetic polypeptide
ASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCPVPSTPPTPSPSTPPTPSPSCCHPRLSLHRPALEDLLLGSEANLTCTLTGLRDASGVTFTWTPSSGKSAVQGPPERDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVDGTCY

SEQ ID NO: 27 - protein, 340 aa, Artificial Sequence
  Description of Artificial Sequence: Synthetic polypeptide
ASPTSPKVFPLSLDSTPQDGNVVVACLVQGFFPQEPLSVTWSESGQNVTARNFPPSQDASGDLYTTSSQLTLPATQCPDGKSVTCHVKHYTNSSQDVTVPCRVPPPPPCCHPRLSLHRPALEDLLLGSEANLTCTLTGLRDASGATFTWTPSSGKSAVQGPPERDLCGCYSVSSVLPGCAQPWNHGETFTCTAAHPELKTPLTANITKSGNTFRPEVHLLPPPSEELALNELVTLTCLARGFSPKDVLVRWLQGSQELPREKYLTWASRQEPSQGTTTYAVTSILRVAAEDWKKGETFSCMVGHEALPLAFTQKTIDRMAGKPTHINVSVVMAEADGTCY

SEQ ID NO: 28 - protein, 852 aa, Artificial Sequence
  Description of Artificial Sequence: Synthetic polypeptide
MSSSSWLLLSLVAVTAAQSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGNIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSPSTPPTPSPSCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVLHEALHSHYTQKSLSLSPGK

SEQ ID NO: 29 - protein, 859 aa, Artificial Sequence
  Description of Artificial Sequence: Synthetic polypeptide
MPMGSLQPLATLYLLGMLVASVLAQSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGNIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSPSTPPTPSPSCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVLHEALHSHYTQKSLSLSPGK

SEQ ID NO: 30 - protein, 854 aa, Artificial Sequence
  Description of Artificial Sequence: Synthetic polypeptide
MPMGSLQPLATLYLLGMLVASVLAQSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 31 - protein, 863 aa, Artificial Sequence
  Description of Artificial Sequence: Synthetic polypeptide
MPMGSLQPLATLYLLGMLVASVLAQSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPSTPPTPSPSTPPTPSPSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 32 - protein, 980 aa, Artificial Sequence
  Description of Artificial Sequence: Synthetic polypeptide
MPMGSLQPLATLYLLGMLVASVLAQSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGNIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTPPTPSPSCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVLHEALHSHYTQKSLSLSPGK

SEQ ID NO: 33 - protein, 976 aa, Artificial Sequence
  Description of Artificial Sequence: Synthetic polypeptide
MPMGSLQPLATLYLLGMLVASVLAQSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGNIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTPPTPSPSCPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVLHEALHSHYTQKSLSLSPGK

SEQ ID NO: 34 - protein, 980 aa, Artificial Sequence
  Description of Artificial Sequence: Synthetic polypeptide
MPMGSLQPLATLYLLGMLVASVLAQSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGNIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDCFRLNDNSLEFLGIQPTLGPPNQPPVSTPPTPSPSCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVLHEALHSHYTQKSLSLSPGK

SEQ ID NO: 35 - protein, 976 aa, Artificial Sequence
  Description of Artificial Sequence: Synthetic polypeptide
MPMGSLQPLATLYLLGMLVASVLAQSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGNIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDCFRLNDNSLEFLGIQPTLGPPNQPPVSTPPTPSPSCPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVLHEALHSHYTQKSLSLSPGK

SEQ ID NO: 36 - protein, 980 aa, Artificial Sequence
  Description of Artificial Sequence: Synthetic polypeptide
MPMGSLQPLATLYLLGMLVASVLAQSTIEEQVKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKVVCHPTAWDLGKGDFRILMCTKVTMDDFLTAHHEMGNIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTPPTPSPSCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVLHEALHSHYTQKSLSLSPGK

SEQ ID NO: 37 - protein, 976 aa, Artificial Sequence
  Description of Artificial Sequence: Synthetic polypeptide
MPMGSLQPLATLYLLGMLVASVLAQSTIEEQVKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKVVCHPTAWDLGKGDFRILMCTKVTMDDFLTAHHEMGNIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTPPTPSPSCPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVLHEALHSHYTQKSLSLSPGK

SEQ ID NO: 38 - protein, 980 aa, Artificial Sequence
  Description of Artificial Sequence: Synthetic polypeptide
MPMGSLQPLATLYLLGMLVASVLAQSTIEEQVKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKVVCHPTAWDLGKGDFRILMCTKVTMDDFLTAHHEMGNIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDCFRLNDNSLEFLGIQPTLGPPNQPPVSTPPTPSPSCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVLHEALHSHYTQKSLSLSPGK

SEQ ID NO: 39 - protein, 976 aa, Artificial Sequence
  Description of Artificial Sequence: Synthetic polypeptide
MPMGSLQPLATLYLLGMLVASVLAQSTIEEQVKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKVVCHPTAWDLGKGDFRILMCTKVTMDDFLTAHHEMGNIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDCFRLNDNSLEFLGIQPTLGPPNQPPVSTPPTPSPSCPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVLHEALHSHYTQKSLSLSPGK

SEQ ID NO: 40 - protein, 859 aa, Artificial Sequence
  Description of Artificial Sequence: Synthetic polypeptide
MPMGSLQPLATLYLLGMLVASVLAQSTIEEQVKTFLDKFNHEAEDLFYQSSLASWNYNTNITEENVQNMNNAGDKWSAFLCEQSTLAQMYPLQEIQNLTVKLQLQALQQNGSCVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKVVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSPSTPPTPSPSCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVLHEALHSHYTQKSLSLSPGK

SEQ ID NO: 41 - protein, 859 aa, Artificial Sequence
  Description of Artificial Sequence: Synthetic polypeptide
MPMGSLQPLATLYLLGMLVASVLAQSTIEEQVKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYCTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKVCSHPTAWDLGKGDFRILMSTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSPSTPPTPSPSCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVLHEALHSHYTQKSLSLSPGK

SEQ ID NO: 42 - protein, 859 aa, Artificial Sequence
  Description of Artificial Sequence: Synthetic polypeptide
MPMGSLQPLATLYLLGMLVASVLAQSTIEEQVKTFLDKFNHEAEDLFYQSSLASWNYNTNITEENVQNMNNAGDKWSAFLCEQSTLAQMYPLQEIQNLTVKLQLQALQQNGSCVLSEDKSKRLNTILNTMSTIYCTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKVCSHPTAWDLGKGDFRILMSTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSPSTPPTPSPSCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVLHEALHSHYTQKSLSLSPGK

SEQ ID NO: 43 - protein, 859 aa, Artificial Sequence
  Description of Artificial Sequence: Synthetic polypeptide
MPMGSLQPLATLYLLGMLVASVLAQSTIEEQVKTFLDKFNHEAEDLFYQSSLASWNYNTNITEENVQNMNNAGDKWSAFLCEQSTLAQMYPLQEIQNLTVKLQLQALQQNGSCVLSEDKSKRLNTILNTMSTIYCTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKVCSWPTAWDLGKGDFRILMSTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSPSTPPTPSPSCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVLHEALHSHYTQKSLSLSPGK

SEQ ID NO: 44 - protein, 859 aa, Artificial Sequence
  Description of Artificial Sequence: Synthetic polypeptide
MPMGSLQPLATLYLLGMLVASVLAQSTIEEQVKTFLDKFNHEAEDLFYQSSLASWNYNTNITEENVQNMNNAGDKWSAFLCEQSTLAQMYPLQEIQNLTVKLQLQALQQNGSCVLSEDKSKRLNTILNTMSTIYCTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKVCSYPTAWDLGKGDFRILMSTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLWHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSPSTPPTPSPSCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVLHEALHSHYTQKSLSLSPGK

SEQ ID NO: 45 - protein, 859 aa, Artificial Sequence
  Description of Artificial Sequence: Synthetic polypeptide
MPMGSLQPLATLYLLGMLVASVLAQSTIEEQVKTFLDKFNHEAEDLFYQSSLASWNYNTNITEENVQNMNNAGDKWSAFLCEQSTLAQMYPLQEIQNLTVKLQLQALQQNGSCVLSEDKSKRLNTILNTMSTIYCTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKVCSWPTAWDLGKGDFRILMSTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLWHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSPSTPPTPSPSCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVLHEALHSHYTQKSLSLSPGK

SEQ ID NO: 46 - protein, 976 aa, Artificial Sequence
  Description of Artificial Sequence: Synthetic polypeptide
MPMGSLQPLATLYLLGMLVASVLAQSTIEEQVKTFLDKFNHEAEDLFYQSSLASWNYNTNITEENVQNMNNAGDKWSAFLCEQSTLAQMYPLQEIQNLTVKLQLQALQQNGSCVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPSGSLPAHLLGDMWGRFWTNLYSLTVPFGQKPNIDVTDAMVDQAWDAQRIFKEAEKFFVSVGLPNMTQGFWENSMLTDPGNVQKVVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSGVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTPPTPSPSCPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVLHEALHSHYTQKSLSLSPGK

SEQ ID NO: 47 - protein, 976 aa, Artificial Sequence
  Description of Artificial Sequence: Synthetic polypeptide
MPMGSLQPLATLYLLGMLVASVLAQSTIEEQVKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYCTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPSGSLPAHLLGDMWGRFWTNLYSLTVPFGQKPNIDVTDAMVDQAWDAQRIFKEAEKFFVSVGLPNMTQGFWENSMLTDPGNVQKVCSHPTAWDLGKGDFRILMSTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSGVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTPPTPSPSCPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVLHEALHSHYTQKSLSLSPGK

SEQ ID NO: 48 - protein, 976 aa, Artificial Sequence
  Description of Artificial Sequence: Synthetic polypeptide
MPMGSLQPLATLYLLGMLVASVLAQSTIEEQVKTFLDKFNHEAEDLFYQSSLASWNYNTNITEENVQNMNNAGDKWSAFLCEQSTLAQMYPLQEIQNLTVKLQLQALQQNGSCVLSEDKSKRLNTILNTMSTIYCTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPSGSLPAHLLGDMWGRFWTNLYSLTVPFGQKPNIDVTDAMVDQAWDAQRIFKEAEKFFVSVGLPNMTQGFWENSMLTDPGNVQKVCSHPTAWDLGKGDFRILMSTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSGVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTPPTPSPSCPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVLHEALHSHYTQKSLSLSPGK

SEQ ID NO: 49 - protein, 976 aa, Artificial Sequence
  Description of Artificial Sequence: Synthetic polypeptide
MPMGSLQPLATLYLLGMLVASVLAQSTIEEQVKTFLDKFNHEAEDLFYQSSLASWNYNTNITEENVQNMNNAGDKWSAFLCEQSTLAQMYPLQEIQNLTVKLQLQALQQNGSCVLSEDKSKRLNTILNTMSTIYCTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPSGSLPAHLLGDMWGRFWTNLYSLTVPFGQKPNIDVTDAMVDQAWDAQRIFKEAEKFFVSVGLPNMTQGFWENSMLTDPGNVQKVCSWPTAWDLGKGDFRILMSTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSGVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTPPTPSPSCPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVLHEALHSHYTQKSLSLSPGK

SEQ ID NO: 50 - protein, 976 aa, Artificial Sequence
  Description of Artificial Sequence: Synthetic polypeptide
MPMGSLQPLATLYLLGMLVASVLAQSTIEEQVKTFLDKFNHEAEDLFYQSSLASWNYNTNITEENVQNMNNAGDKWSAFLCEQSTLAQMYPLQEIQNLTVKLQLQALQQNGSCVLSEDKSKRLNTILNTMSTIYCTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPSGSLPAHLLGDMWGRFWTNLYSLTVPFGQKPNIDVTDAMVDQAWDAQRIFKEAEKFFVSVGLPNMTQGFWENSMLTDPGNVQKVCSWPTAWDLGKGDFRILMSTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLWHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSGVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTPPTPSPSCPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVLHEALHSHYTQKSLSLSPGK

SEQ ID NO: 51 - protein, 970 aa, Artificial Sequence
  Description of Artificial Sequence: Synthetic polypeptide
MALSWVLTVLSLLPLLEAQSTIEEQVKTFLDKFNHEAEDLFYQSSLASWNYNTNITEENVQNMNNAGDKWSAFLCEQSTLAQMYPLQEIQNLTVKLQLQALQQNGSCVLSEDKSKRLNTILNTMSTIYCTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPSGSLPAHLLGDMWGRFWTNLYSLTVPFGQKPNIDVTDAMVDQAWDAQRIFKEAEKFFVSVGLPNMTQGFWENSMLTDPGNVQKVCSWPTAWDLGKGDFRILMSTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLWHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSGVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTPPTPSPSCPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVLHEALHSHYTQKSLSLSPGK

SEQ ID NO: 52 - protein, 970 aa, Artificial Sequence
  Description of Artificial Sequence: Synthetic polypeptide
MALSWVLTVLSLLPLLEAQSTIEEQVKTFLDKFNHEAEDLFYQSSLASWNYNTNITEENVQNMNNAGDKWSAFLCEQSTLAQMYPLQEIQNLTVKLQLQALQQNGSCVLSEDKSKRLNTILNTMSTIYCTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPSGSLPAHLLGDMWGRFWTNLYSLTVPFGQKPNIDVTDAMVDQAWDAQRIFKEAEKFFVSVGLPNMTQGFWENSMLTDPGNVQKVCSWPTAWDLGKGDFRILMSTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLWHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSGVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDCFRLNDNSLEFLGIQPTLGPPNQPPVSTPPTPSPSCPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVLHEALHSHYTQKSLSLSPGK

SEQ ID NO: 53 - protein, 853 aa, Artificial Sequence
  Description of Artificial Sequence: Synthetic polypeptide
MPMGSLQPLATLYLLGMLVASVLAQSTIEEQVKTFLDKFNHEAEDLFYQSSLASWNYNTNITEENVQNMNNAGDKWSAFLCEQSTLAQMYPLQEIQNLTVKLQLQALQQNGSCVLSEDKSKRLNTILNTMSTIYCTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPSGSLPAHLLGDMWGRFWTNLYSLTVPFGQKPNIDVTDAMVDQAWDAQRIFKEAEKFFVSVGLPNMTQGFWENSMLTDPGNVQKVCSWPTAWDLGKGDFRILMSTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLWHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSGVGWSTDWSPYADQSTPPTPSPSCPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVLHEALHSHYTQKSLSLSPGK

SEQ ID NO: 54 - protein, 988 aa, Artificial Sequence
  Description of Artificial Sequence: Synthetic polypeptide
MALSWVLTVLSLLPLLEAQSTIEEQVKTFLDKFNHEAEDLFYQSSLASWNYNTNITEENVQNMNNAGDKWSAFLCEQSTLAQMYPLQEIQNLTVKLQLQALQQNGSCVLSEDKSKRLNTILNTMSTIYCTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPSGSLPAHLLGDMWGRFWTNLYSLTVPFGQKPNIDVTDAMVDQAWDAQRIFKEAEKFFVSVGLPNMTQGFWENSMLTDPGNVQKVCSWPTAWDLGKGDFRILMSTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLWHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSGVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDCFRLNDNSLEFLGIQPTLGPPNQPPVSTPPTPSTPPTPSPSTPPTPSPSCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVLHEALHSHYTQKSLSLSPGK

SEQ ID NO: 55 - protein, 871 aa, Artificial Sequence
  Description of Artificial Sequence: Synthetic polypeptide
MPMGSLQPLATLYLLGMLVASVLAQSTIEEQVKTFLDKFNHEAEDLFYQSSLASWNYNTNITEENVQNMNNAGDKWSAFLCEQSTLAQMYPLQEIQNLTVKLQLQALQQNGSCVLSEDKSKRLNTILNTMSTIYCTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPSGSLPAHLLGDMWGRFWTNLYSLTVPFGQKPNIDVTDAMVDQAWDAQRIFKEAEKFFVSVGLPNMTQGFWENSMLTDPGNVQKVCSWPTAWDLGKGDFRILMSTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLWHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSGVGWSTDWSPYADQSTPPTPSTPPTPSPSTPPTPSPSCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVLHEALHSHYTQKSLSLSPGK

SEQ ID NO: 56 - DNA, 3339 bp, Homo sapiens
agtctagggaaagtcattcagtggatgtgatcttggctcacaggggacgatgtcaagctcttcctggctccttctcagccttgttgctgtaactgctgctcagtccaccattgaggaacaggccaagacatttttggacaagtttaaccacgaagccgaagacctgttctatcaaagttcacttgcttcttggaattataacaccaatattactgaagagaatgtccaaaacatgaataatgctggggacaaatggtctgcctttttaaaggaacagtccacacttgcccaaatgtatccactacaagaaattcagaatctcacagtcaagcttcagctgcaggctcttcagcaaaatgggtcttcagtgctctcagaagacaagagcaaacggttgaacacaattctaaatacaatgagcaccatctacagtactggaaaagtttgtaacccagataatccacaagaatgcttattacttgaaccaggtttgaatgaaataatggcaaacagtttagactacaatgagaggctctgggcttgggaaagctggagatctgaggtcggcaagcagctgaggccattatatgaagagtatgtggtcttgaaaaatgagatggcaagagcaaatcattatgaggactatggggattattggagaggagactatgaagtaaatggggtagatggctatgactacagccgcggccagttgattgaagatgtggaacatacctttgaagagattaaaccattatatgaacatcttcatgcctatgtgagggcaaagttgatgaatgcctatccttcctatatcagtccaattggatgcctccctgctcatttgcttggtgatatgtggggtagattttggacaaatctgtactctttgacagttccctttggacagaaaccaaacatagatgttactgatgcaatggtggaccaggcctgggatgcacagagaatattcaaggaggccgagaagttctttgtatctgttggtcttcctaatatgactcaaggattctgggaaaattccatgctaacggacccaggaaatgttcagaaagcagtctgccatcccacagcttgggacctggggaagggcgacttcaggatccttatgtgcacaaaggtgacaatggacgacttcctgacagctcatcatgagatggggcatatccagtatgatatggcatatgctgcacaaccttttctgctaagaaatggagctaatgaaggattccatgaagctgttggggaaatcatgtcactttctgcagccacacctaagcatttaaaatccattggtcttctgtcacccgattttcaagaagacaatgaaacagaaataaacttcctgctcaaacaagcactcacgattgttgggactctgccatttacttacatgttagagaagtggaggtggatggtctttaaaggggaaattcccaaagaccagtggatgaaaaagtggtgggagatgaagcgagagatagttggggtggtggaacctgtgccccatgatgaaacatactgtgaccccgcatctctgttccatgtttctaatgattactcattcattcgatattacacaaggaccctttaccaattccagtttcaagaagcactttgtcaagcagctaaacatgaaggccctctgcacaaatgtgacatctcaaactctacagaagctggacagaaactgttcaatatgctgaggcttggaaaatcagaaccctggaccctagcattggaaaatgttgtaggagcaaagaacatgaatgtaaggccactgctcaactactttgagcccttatttacctggctgaaagaccagaacaagaattcttttgtgggatggagtaccgactggagtccatatgcagaccaaagcatcaaagtgaggataagcctaaaatcagctcttggagataaagcatatgaatggaacgacaatgaaatgtacctgttccgatcatctgttgcatatgctatgaggcagtactttttaaaagtaaaaaatcagatgattctttttggggaggaggatgtgcgagtggctaatttgaaaccaagaatctcctttaatttctttgtcactgcacctaaaaatgtgtctgatatcattcctagaactgaagttgaaaaggccatcaggatgtcccggagccgtatcaatgatgctttccgtctgaatgacaacagcctagagtttctggggatacagccaacacttggacctcctaaccagccccctgtttccatatggctgattgtttttggagttgtgatgggagtgatagtggttggcattgtcatcctgatcttcactgggatcagagatcggaagaagaaaaataaagcaagaagtggagaaaatccttatgcctccatcgatattagcaaaggagaaaataatccaggattccaaaacactgatgatgttcagacctccttttagaaaaatctatgtttttcctcttgaggtgattttgttgtatgtaaatgttaatttcatggtatagaaaatataagatgataaagatatcattaaatgtcaaaactatgactctgttcagaaaaaaaattgtccaaagacaacatggccaaggagagagcatcttcattgacattgctttcagtatttatttctgtctctggatttgacttctgttctgtttcttaataaggattttgtattagagtatattagggaaagtgtgtatttggtctcacaggctgttcagggataatctaaatgtaaatgtctgttgaatttctgaagttgaaaacaaggatatatcattggagcaagtgttggatcttgtatggaatatggatggatcacttgtaaggacagtgcctgggaactggtgtagctgcaaggattgagaatggcatgcattagctcactttcatttaatccattgtcaaggatgacatgctttcttcacagtaactcagttcaagtactatggtgatttgcctacagtgatgtttggaatcgatcatgctttcttcaaggtgacaggtctaaagagagaagaatccagggaacaggtagaggacattgctttttcacttccaaggtgcttgatcaacatctccctgacaacacaaaactagagccaggggcctccgtgaactcccagagcatgcctgatagaaactcatttctactgttctctaactgtggagtgaatggaaattccaactgtatgttcaccctctgaagtgggtacccagtctcttaaatcttttgtatttgctcacagtgtttgagcagtgctgagcacaaagcagacactcaataaatgctagatttacacactc

SEQ ID NO: 57 - DNA, 2907 bp, Artificial Sequence
  Description of Artificial Sequence: Synthetic polynucleotide
gctagccgccaccatgtcaagctctagctggctcctgctcagcctcgtcgccgtaaccgccgcacagagcaccattgaagaacaagtcaaaacattctttgacaaattcaaccacgaagccgaagacctgttctaccaaagctcactcgcaagctggaactacaacacaaacatcaccgaagagaacgtccaaaacatgaacaacgccggagacaaatggagcgcattcctctgtgaacaaagcacactcgcccaaatgtacccactccaagaaatccaagacctgaccgtcaagctgcagctgcaggcactgcagcagaacggaagctgtgtactgagcgaagacaaatccaaacgcctaaacacaatactaaacacaatgagcacaatctacagcaccggaaaagtatgcaacccagacaatccacaagaatgcctgctgctggaacccggactcaacgaaatcatggccaactcactagactacaacgaaagactctgggcatgggaaagctggcgctcagaagtcggcaaacaactcagaccactctatgaagaatacgtagtcctcaaaaatgaaatggcacgcgcaaaccactacgaagactacggcgactactggagaggcgactacgaagtaaacggagtcgacggctacgactactcaagaggacaactaatagaagacgtcgaacacacattcgaagaaatcaaaccactctacgaacacctccacgcatacgtacgagcaaaactcatgaacgcctacccatcatacatcagcccaacaggaccactaccagcacacctactaggcgacatgtggggaagattctggacaaacctgtacagcctgacagtaccattcggacagaaaccaaacatagacgtcaccgacgcaatggtcgaccaagcctgggacgcacagagaatattcaaagaagccgaaaaattcttcgtatccgtcggactccccaacatgacacaaggattctgggaaaactccatgctgacagaccccggaaacggccagaaagtcgtctgctacccaacagcctgggacctaggcaaaggcgacttcagaatcctgatgtgcaccaaagtcacaatggacgacttcctgacagcccaccacgaaatgggccacatccaatacgacatggcatacctggcacaaccattcctactacgcaacggagccaacgaaggattccacgaagccgtcggcgaaatcatgtcactgagtgcagccacacccaagcacctgaaaagcatcggactgctgagcccagacttccaagaagacaacgaaaccgaaataaacttcctactaaaacaagcactgacaatcgtcggaaccctgccattcacctacatgctggaaaaatggagatggatggtcttcaaaggagaaatcccaaaagaccagtggatgaaaaaatggtgggaaatgaaacgcgaaatagtaggagtcgtcgaaccagtaccacacgacgaaacatactgcgacccagcatcactattccacgtatcaaacgactacagcttcatacgctactacacaagaacactgtaccaattccaattccaagaagcactatgccaagcagccaagcacgaaggcccactgcacaaatgcgacatcagcaactccaccgaagccggacagaagctcttcaacatgctgagactgggaaaatcagaaccatggaccctggcactggaaaacgtagtcggagccaagaacatgaacgtacgaccactcctcaactacttcgaaccactcttcacatggctcaaagaccaaaacaagaattcatttgtaggatggagcacagactggagcccatatgctgatcaaagcatcaaaatcagactgtcactaaaatcagcactaggagacaaagcctatgaatggaatgacaatgagatgtacctgtttagaagctctgtagcctatgtcatgagacaatacttcagcaaagtcaaaaaccagatgattggatttggagaagaagatgtcagagtagccaatctgaagcctagaatcagcttcaacttctttctgactgcacctaagaatgtatcagacatcactccaagaacagaagtagaaaaagccatcagaatgagcagaagcagaatcaatgactgcttcagactgaatgacaacagcctggagttcctgggaatccagcctacactgggaccaccaaaccaaccaccagtagaatgtccaccatgtccagcaccaccagtagcaggaccaagtgtattcctattcccaccaaagccaaaagacacactaatgatatctagaacacctgaagtgacctgtgtagtagtagatgtatcccatgaagaccctgaagtccaattcaattggtatgtggatggagtggaagtacacaatgccaagaccaaaccaagagaagagcaattcaatagcacattcagagtagtatctgtactcactgtagtgcaccaagactggctcaatggcaaagaatacaaatgcaaagtgtccaacaaaggactccctgcaccaattgaaaagactatctccaagaccaaaggacaaccaagagagccacaagtctacacactgccaccaagtagagaagagatgaccaagaaccaagtatcactgacatgccttgtcaaaggattctaccctagtgacattagtgtagaatgggaaagtaatggacaacctgaaaacaactacaagacaacaccaccaatgctggatagtgatggcagcttcttcctgtactcaaaactgactgtagacaaaagtagatggcaacaaggaaatgtgtttagctgttctgtactgcatgaagcactgcacagccactacacacaaaaaagcctgagtctgagccctggcaagtgataggatcc

SEQ ID NO: 58 - protein, 961 aa, Artificial Sequence
  Description of Artificial Sequence: Synthetic polypeptide
MSSSSWLLLSLVAVTAAQSTIEEQVKTFFDKFNHEAEDLFYQSSLASWNYNTNITEENVQNMNNAGDKWSAFLCEQSTLAQMYPLQEIQDLTVKLQLQALQQNGSCVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPTGPLPAHLLGDMWGRFWTNLYSLTVPFGQKPNIDVTDAMVDQAWDAQRIFKEAEKFFVSVGLPNMTQGFWENSMLTDPGNGQKVVCYPTAWDLGKGDFRILMCTKVTMDDFLTAHHEMGHIQYDMAYLAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKIRLSLKSALGDKAYEWNDNEMYLFRSSVAYVMRQYFSKVKNQMIGFGEEDVRVANLKPRISFNFFLTAPKNVSDITPRTEVEKAIRMSRSRINDCFRLNDNSLEFLGIQPTLGPPNQPPVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVLHEALHSHYTQKSLSLSPGK

SEQ ID NO: 59 - DNA, 2967 bp, Artificial Sequence
  Description of Artificial Sequence: Synthetic polynucleotide
gctagccgccaccatgtcaagctctagctggctcctgctcagcctcgtcgccgtaaccgccgcacagagcaccattgaagaacaagtcaaaacattctttgacaaattcaaccacgaagccgaagacctgttctaccaaagctcactcgcaagctggaactacaacacaaacatcaccgaagagaacgtccaaaacatgaacaacgccggagacaaatggagcgcattcctctgtgaacaaagcacactcgcccaaatgtacccactccaagaaatccaagacctgaccgtcaagctgcagctgcaggcactgcagcagaacggaagctgtgtactgagcgaagacaaatccaaacgcctaaacacaatactaaacacaatgagcacaatctacagcaccggaaaagtatgcaacccagacaatccacaagaatgcctgctgctggaacccggactcaacgaaatcatggccaactcactagactacaacgaaagactctgggcatgggaaagctggcgctcagaagtcggcaaacaactcagaccactctatgaagaatacgtagtcctcaaaaatgaaatggcacgcgcaaaccactacgaagactacggcgactactggagaggcgactacgaagtaaacggagtcgacggctacgactactcaagaggacaactaatagaagacgtcgaacacacattcgaagaaatcaaaccactctacgaacacctccacgcatacgtacgagcaaaactcatgaacgcctacccatcatacatcagcccaacaggaccactaccagcacacctactaggcgacatgtggggaagattctggacaaacctgtacagcctgacagtaccattcggacagaaaccaaacatagacgtcaccgacgcaatggtcgaccaagcctgggacgcacagagaatattcaaagaagccgaaaaattcttcgtatccgtcggactccccaacatgacacaaggattctgggaaaactccatgctgacagaccccggaaacggccagaaagtcgtctgctacccaacagcctgggacctaggcaaaggcgacttcagaatcctgatgtgcaccaaagtcacaatggacgacttcctgacagcccaccacgaaatgggccacatccaatacgacatggcatacctggcacaaccattcctactacgcaacggagccaacgaaggattccacgaagccgtcggcgaaatcatgtcactgagtgcagccacacccaagcacctgaaaagcatcggactgctgagcccagacttccaagaagacaacgaaaccgaaataaacttcctactaaaacaagcactgacaatcgtcggaaccctgccattcacctacatgctggaaaaatggagatggatggtcttcaaaggagaaatcccaaaagaccagtggatgaaaaaatggtgggaaatgaaacgcgaaatagtaggagtcgtcgaaccagtaccacacgacgaaacatactgcgacccagcatcactattccacgtatcaaacgactacagcttcatacgctactacacaagaacactgtaccaattccaattccaagaagcactatgccaagcagccaagcacgaaggcccactgcacaaatgcgacatcagcaactccaccgaagccggacagaagctcttcaacatgctgagactgggaaaatcagaaccatggaccctggcactggaaaacgtagtcggagccaagaacatgaacgtacgaccactcctcaactacttcgaaccactcttcacatggctcaaagaccaaaacaagaattcatttgtaggatggagcacagactggagcccatatgctgatcaaagcatcaaaatcagactgtcactaaaatcagcactaggagacaaagcctatgaatggaatgacaatgagatgtacctgtttagaagctctgtagcctatgtcatgagacaatacttcagcaaagtcaaaaaccagatgattggatttggagaagaagatgtcagagtagccaatctgaagcctagaatcagcttcaacttctttctgactgcacctaagaatgtatcagacatcactccaagaacagaagtagaaaaagccatcagaatgagcagaagcagaatcaatgactgcttcagactgaatgacaacagcctggagttcctgggaatccagcctacactgggaccaccaaaccaaccaccagtatcaacaccacctacaccaagtccaagcacaccaccaacaccaagcccatcatgctgtgtagaatgtccaccatgcccagcaccaccagtagcaggaccaagtgtattcctattcccaccaaagccaaaagacacactaatgatatctagaacacctgaagtgacctgtgtagtagtagatgtatcccatgaagaccctgaagtccaattcaattggtatgtggatggagtggaagtacacaatgccaagaccaaaccaagagaagagcaattcaatagcacattcagagtagtatctgtactcactgtagtgcaccaagactggctcaatggcaaagaatacaaatgcaaagtgtccaacaaaggactccctgcaccaattgaaaagactatctccaagaccaaaggacaaccaagagagccacaagtctacacactgccaccaagtagagaagagatgaccaagaaccaagtatcactgacatgccttgtcaaaggattctaccctagtgacattagtgtagaatgggaaagtaatggacaacctgaaaacaactacaagacaacaccaccaatgctggatagtgatggcagcttcttcctgtactcaaaactgactgtagacaaaagtagatggcaacaaggaaatgtgtttagctgttctgtactgcatgaagcactgcacagccactacacacaaaaaagcctgagtctgagccctggcaagtgataggatcc

SEQ ID NO: 60 - protein, 981 aa, Artificial Sequence
  Description of Artificial Sequence: Synthetic polypeptide
MSSSSWLLLSLVAVTAAQSTIEEQVKTFFDKFNHEAEDLFYQSSLASWNYNTNITEENVQNMNNAGDKWSAFLCEQSTLAQMYPLQEIQDLTVKLQLQALQQNGSCVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPTGPLPAHLLGDMWGRFWTNLYSLTVPFGQKPNIDVTDAMVDQAWDAQRIFKEAEKFFVSVGLPNMTQGFWENSMLTDPGNGQKVVCYPTAWDLGKGDFRILMCTKVTMDDFLTAHHEMGHIQYDMAYLAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKIRLSLKSALGDKAYEWNDNEMYLFRSSVAYVMRQYFSKVKNQMIGFGEEDVRVANLKPRISFNFFLTAPKNVSDITPRTEVEKAIRMSRSRINDCFRLNDNSLEFLGIQPTLGPPNQPPVSTPPTPSPSTPPTPSPSCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVLHEALHSHYTQKSLSLSPGK

SEQ ID NO: 61 - DNA, 2922 bp, Artificial Sequence
  Description of Artificial Sequence: Synthetic polynucleotide
gctagccgccaccatgtcaagctctagctggctcctgctcagcctcgtcgccgtaaccgccgcacagagcaccattgaagaacaagtcaaaacattctttgacaaattcaaccacgaagccgaagacctgttctaccaaagctcactcgcaagctggaactacaacacaaacatcaccgaagagaacgtccaaaacatgaacaacgccggagacaaatggagcgcattcctctgtgaacaaagcacactcgcccaaatgtacccactccaagaaatccaagacctgaccgtcaagctgcagctgcaggcactgcagcagaacggaagctgtgtactgagcgaagacaaatccaaacgcctaaacacaatactaaacacaatgagcacaatctacagcaccggaaaagtatgcaacccagacaatccacaagaatgcctgctgctggaacccggactcaacgaaatcatggccaactcactagactacaacgaaagactctgggcatgggaaagctggcgctcagaagtcggcaaacaactcagaccactctatgaagaatacgtagtcctcaaaaatgaaatggcacgcgcaaaccactacgaagactacggcgactactggagaggcgactacgaagtaaacggagtcgacggctacgactactcaagaggacaactaatagaagacgtcgaacacacattcgaagaaatcaaaccactctacgaacacctccacgcatacgtacgagcaaaactcatgaacgcctacccatcatacatcagcccaacaggaccactaccagcacacctactaggcgacatgtggggaagattctggacaaacctgtacagcctgacagtaccattcggacagaaaccaaacatagacgtcaccgacgcaatggtcgaccaagcctgggacgcacagagaatattcaaagaagccgaaaaattcttcgtatccgtcggactccccaacatgacacaaggattctgggaaaactccatgctgacagaccccggaaacggccagaaagtcgtctgctacccaacagcctgggacctaggcaaaggcgacttcagaatcctgatgtgcaccaaagtcacaatggacgacttcctgacagcccaccacgaaatgggccacatccaatacgacatggcatacctggcacaaccattcctactacgcaacggagccaacgaaggattccacgaagccgtcggcgaaatcatgtcactgagtgcagccacacccaagcacctgaaaagcatcggactgctgagcccagacttccaagaagacaacgaaaccgaaataaacttcctactaaaacaagcactgacaatcgtcggaaccctgccattcacctacatgctggaaaaatggagatggatggtcttcaaaggagaaatcccaaaagaccagtggatgaaaaaatggtgggaaatgaaacgcgaaatagtaggagtcgtcgaaccagtaccacacgacgaaacatactgcgacccagcatcactattccacgtatcaaacgactacagcttcatacgctactacacaagaacactgtaccaattccaattccaagaagcactatgccaagcagccaagcacgaaggcccactgcacaaatgcgacatcagcaactccaccgaagccggacagaagctcttcaacatgctgagactgggaaaatcagaaccatggaccctggcactggaaaacgtagtcggagccaagaacatgaacgtacgaccactcctcaactacttcgaaccactcttcacatggctcaaagaccaaaacaagaattcatttgtaggatggagcacagactggagcccatatgctgatcaaagcatcaaaatcagactgtcactaaaatcagcactaggagacaaagcctatgaatggaatgacaatgagatgtacctgtttagaagctctgtagcctatgtcatgagacaatacttcagcaaagtcaaaaaccagatgattggatttggagaagaagatgtcagagtagccaatctgaagcctagaatcagcttcaacttctttctgactgcacctaagaatgtatcagacatcactccaagaacagaagtagaaaaagccatcagaatgagcagaagcagaatcaatgactgcttcagactgaatgacaacagcctggagttcctgggaatccagcctacactgggaccaccaaaccaaccaccaccaccaccatgctgtgtagaatgtccaccatgcccagcaccaccagtagcaggaccaagtgtattcctattcccaccaaagccaaaagacacactaatgatatctagaacacctgaagtgacctgtgtagtagtagatgtatcccatgaagaccctgaagtccaattcaattggtatgtggatggagtggaagtacacaatgccaagaccaaaccaagagaagagcaattcaatagcacattcagagtagtatctgtactcactgtagtgcaccaagactggctcaatggcaaagaatacaaatgcaaagtgtccaacaaaggactccctgcaccaattgaaaagactatctccaagaccaaaggacaaccaagagagccacaagtctacacactgccaccaagtagagaagagatgaccaagaaccaagtatcactgacatgccttgtcaaaggattctaccctagtgacattagtgtagaatgggaaagtaatggacaacctgaaaacaactacaagacaacaccaccaatgctggatagtgatggcagcttcttcctgtactcaaaactgactgtagacaaaagtagatggcaacaaggaaatgtgtttagctgttctgtactgcatgaagcactgcacagccactacacacaaaaaagcctgagtctgagccctggcaagtgataggatcc

SEQ ID NO: 62 - protein, 966 aa, Artificial Sequence
  Description of Artificial Sequence: Synthetic polypeptide
MSSSSWLLLSLVAVTAAQSTIEEQVKTFFDKFNHEAEDLFYQSSLASWNYNTNITEENVQNMNNAGDKWSAFLCEQSTLAQMYPLQEIQDLTVKLQLQALQQNGSCVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPTGPLPAHLLGDMWGRFWTNLYSLTVPFGQKPNIDVTDAMVDQAWDAQRIFKEAEKFFVSVGLPNMTQGFWENSMLTDPGNGQKVVCYPTAWDLGKGDFRILMCTKVTMDDFLTAHHEMGHIQYDMAYLAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKIRLSLKSALGDKAYEWNDNEMYLFRSSVAYVMRQYFSKVKNQMIGFGEEDVRVANLKPRISFNFFLTAPKNVSDITPRTEVEKAIRMSRSRINDCFRLNDNSLEFLGIQPTLGPPNQPPPPPCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVLHEALHSHYTQKSLSLSPGK

SEQ ID NO: 63 - DNA, 2919 bp, Artificial Sequence
  Description of Artificial Sequence: Synthetic polynucleotide
gctagccgccaccatgtcaagctctagctggctcctgctcagcctcgtcgccgtaaccgccgcacagagcaccattgaagaacaagtcaaaacattctttgacaaattcaaccacgaagccgaagacctgttctaccaaagctcactcgcaagctggaactacaacacaaacatcaccgaagagaacgtccaaaacatgaacaacgccggagacaaatggagcgcattcctctgtgaacaaagcacactcgcccaaatgtacccactccaagaaatccaagacctgaccgtcaagctgcagctgcaggcactgcagcagaacggaagctgtgtactgagcgaagacaaatccaaacgcctaaacacaatactaaacacaatgagcacaatctacagcaccggaaaagtatgcaacccagacaatccacaagaatgcctgctgctggaacccggactcaacgaaatcatggccaactcactagactacaacgaaagactctgggcatgggaaagctggcgctcagaagtcggcaaacaactcagaccactctatgaagaatacgtagtcctcaaaaatgaaatggcacgcgcaaaccactacgaagactacggcgactactggagaggcgactacgaagtaaacggagtcgacggctacgactactcaagaggacaactaatagaagacgtcgaacacacattcgaagaaatcaaaccactctacgaacacctccacgcatacgtacgagcaaaactcatgaacgcctacccatcatacatcagcccaacaggaccactaccagcacacctactaggcgacatgtggggaagattctggacaaacctgtacagcctgacagtaccattcggacagaaaccaaacatagacgtcaccgacgcaatggtcgaccaagcctgggacgcacagagaatattcaaagaagccgaaaaattcttcgtatccgtcggactccccaacatgacacaaggattctgggaaaactccatgctgacagaccccggaaacggccagaaagtcgtctgctacccaacagcctgggacctaggcaaaggcgacttcagaatcctgatgtgcaccaaagtcacaatggacgacttcctgacagcccaccacgaaatgggccacatccaatacgacatggcatacctggcacaaccattcctactacgcaacggagccaacgaaggattccacgaagccgtcggcgaaatcatgtcactgagtgcagccacacccaagcacctgaaaagcatcggactgctgagcccagacttccaagaagacaacgaaaccgaaataaacttcctactaaaacaagcactgacaatcgtcggaaccctgccattcacctacatgctggaaaaatggagatggatggtcttcaaaggagaaatcccaaaagaccagtggatgaaaaaatggtgggaaatgaaacgcgaaatagtaggagtcgtcgaaccagtaccacacgacgaaacatactgcgacccagcatcactattccacgtatcaaacgactacagcttcatacgctactacacaagaacactgtaccaattccaattccaagaagcactatgccaagcagccaagcacgaaggcccactgcacaaatgcgacatcagcaactccaccgaagccggacagaagctcttcaacatgctgagactgggaaaatcagaaccatggaccctggcactggaaaacgtagtcggagccaagaacatgaacgtacgaccactcctcaactacttcgaaccactcttcacatggctcaaagaccaaaacaagaattcatttgtaggatggagcacagactggagcccatatgctgatcaaagcatcaaaatcagactgtcactaaaatcagcactaggagacaaagcctatgaatggaatgacaatgagatgtacctgtttagaagctctgtagcctatgtcatgagacaatacttcagcaaagtcaaaaaccagatgattggatttggagaagaagatgtcagagtagccaatctgaagcctagaatcagcttcaacttctttctgactgcacctaagaatgtatcagacatcactccaagaacagaagtagaaaaagccatcagaatgagcagaagcagaatcaatgactgcttcagactgaatgacaacagcctggagttcctgggaatccagcctacactgggaccaccaaaccaaccaccagtaagtgacaagacgcacacctgcccgccgtgtcccgcccctgaggcagccggtggccccagtgtgttcctgttcccgcctaaacctaaggacacactgatgatctcaagaacccctgaggtgacgtgcgttgttgttgacgtgtcccatgaagatccagaagttaagttcaactggtatgtggatggagtggaagttcataacgccaagaccaaacccagagaggagcaatacaacagcacttatagagttgttagtgttctcacagtgctccaccaggattggctgaacggcaaggaatacaagtgtaaagtgtccaacaaggctttgcccgcgcctatcgaaaagactatctctaaagcgaaaggccagccaagagaaccacaggtttataccctcccaccaagcagagaggaaatgactaaaaatcaggtgtcactcacctgtttggtgaagggcttctacccctccgacatcgctgttgaatgggagtccaacggccagccagaaaataactataagacaacgccgccagtacttgactctgacgggtccttcttcttatattcaaagctgaccgtcgacaaatccaggtggcagcagggaaacgtattcagctgcagtgtactgcacgaggctttacatagccattatacccagaagtcactaagccctggcaagtgataggatcc

SEQ ID NO: 64 - protein, 965 aa, Artificial Sequence
  Description of Artificial Sequence: Synthetic polypeptide
MSSSSWLLLSLVAVTAAQSTIEEQVKTFFDKFNHEAEDLFYQSSLASWNYNTNITEENVQNMNNAGDKWSAFLCEQSTLAQMYPLQEIQDLTVKLQLQALQQNGSCVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPTGPLPAHLLGDMWGRFWTNLYSLTVPFGQKPNIDVTDAMVDQAWDAQRIFKEAEKFFVSVGLPNMTQGFWENSMLTDPGNGQKVVCYPTAWDLGKGDFRILMCTKVTMDDFLTAHHEMGHIQYDMAYLAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKIRLSLKSALGDKAYEWNDNEMYLFRSSVAYVMRQYFSKVKNQMIGFGEEDVRVANLKPRISFNFFLTAPKNVSDITPRTEVEKAIRMSRSRINDCFRLNDNSLEFLGIQPTLGPPNQPPVSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSPGK

SEQ ID NO: 65 - DNA, 2919 bp, Artificial Sequence
  Description of Artificial Sequence: Synthetic polynucleotide
gctagccgccaccatgtcaagctctagctggctcctgctcagcctcgtcgccgtaaccgccgcacagagcaccattgaagaacaagtcaaaacattctttgacaaattcaaccacgaagccgaagacctgttctaccaaagctcactcgcaagctggaactacaacacaaacatcaccgaagagaacgtccaaaacatgaacaacgccggagacaaatggagcgcattcctctgtgaacaaagcacactcgcccaaatgtacccactccaagaaatccaagacctgaccgtcaagctgcagctgcaggcactgcagcagaacggaagctgtgtactgagcgaagacaaatccaaacgcctaaacacaatactaaacacaatgagcacaatctacagcaccggaaaagtatgcaacccagacaatccacaagaatgcctgctgctggaacccggactcaacgaaatcatggccaactcactagactacaacgaaagactctgggcatgggaaagctggcgctcagaagtcggcaaacaactcagaccactctatgaagaatacgtagtcctcaaaaatgaaatggcacgcgcaaaccactacgaagactacggcgactactggagaggcgactacgaagtaaacggagtcgacggctacgactactcaagaggacaactaatagaagacgtcgaacacacattcgaagaaatcaaaccactctacgaacacctccacgcatacgtacgagcaaaactcatgaacgcctacccatcatacatcagcccaacaggaccactaccagcacacctactaggcgacatgtggggaagattctggacaaacctgtacagcctgacagtaccattcggacagaaaccaaacatagacgtcaccgacgcaatggtcgaccaagcctgggacgcacagagaatattcaaagaagccgaaaaattcttcgtatccgtcggactccccaacatgacacaaggattctgggaaaactccatgctgacagaccccggaaacggccagaaagtcgtctgctacccaacagcctgggacctaggcaaaggcgacttcagaatcctgatgtgcaccaaagtcacaatggacgacttcctgacagcccaccacgaaatgggccacatccaatacgacatggcatacctggcacaaccattcctactacgcaacggagccaacgaaggattccacgaagccgtcggcgaaatcatgtcactgagtgcagccacacccaagcacctgaaaagcatcggactgctgagcccagacttccaagaagacaacgaaaccgaaataaacttcctactaaaacaagcactgacaatcgtcggaaccctgccattcacctacatgctggaaaaatggagatggatggtcttcaaaggagaaatcccaaaagaccagtggatgaaaaaatggtgggaaatgaaacgcgaaatagtaggagtcgtcgaaccagtaccacacgacgaaacatactgcgacccagcatcactattccacgtatcaaacgactacagcttcatacgctactacacaagaacactgtaccaattccaattccaagaagcactatgccaagcagccaagcacgaaggcccactgcacaaatgcgacatcagcaactccaccgaagccggacagaagctcttcaacatgctgagactgggaaaatcagaaccatggaccctggcactggaaaacgtagtcggagccaagaacatgaacgtacgaccactcctcaactacttcgaaccactcttcacatggctcaaagaccaaaacaagaattcatttgtaggatggagcacagactggagcccatatgctgatcaaagcatcaaaatcagactgtcactaaaatcagcactaggagacaaagcctatgaatggaatgacaatgagatgtacctgtttagaagctctgtagcctatgtcatgagacaatacttcagcaaagtcaaaaaccagatgattggatttggagaagaagatgtcagagtagccaatctgaagcctagaatcagcttcaacttctttctgactgcacctaagaatgtatcagacatcactccaagaacagaagtagaaaaagccatcagaatgagcagaagcagaatcaatgactgcttcagactgaatgacaacagcctggagttcctgggaatccagcctacactgggaccaccaaaccaaccaccagtaagtgacaagacgcacacctgcccgccgtgtcccgcccctgagctactgggtggccccagtgtgttcctgttcccgcctaaacctaaggacacactgatgatctcaagaacccctgaggtgacgtgcgttgttgttgacgtgtcccatgaagatccagaagttaagttcaactggtatgtggatggagtggaagttcataacgccaagaccaaacccagagaggagcaatacaacagcacttatagagttgttagtgttctcacagtgctccaccaggattggctgaacggcaaggaatacaagtgtaaagtgtccaacaaggctttgcccgcgcctatcgaaaagactatctctaaagcgaaaggccagccaagagaaccacaggtttataccctcccaccaagcagagaggaaatgactaaaaatcaggtgtcactcacctgtttggtgaagggcttctacccctccgacatcgctgttgaatgggagtccaacggccagccagaaaataactataagacaacgccgccagtacttgactctgacgggtccttcttcttatattcaaagctgaccgtcgacaaatccaggtggcagcagggaaacgtattcagctgcagtgtactgcacgaggctttacatagccattatacccagaagtcactaagccctggcaagtgataggatcc

SEQ ID NO: 66 - protein, 965 aa, Artificial Sequence
  Description of Artificial Sequence: Synthetic polypeptide
MSSSSWLLLSLVAVTAAQSTIEEQVKTFFDKFNHEAEDLFYQSSLASWNYNTNITEENVQNMNNAGDKWSAFLCEQSTLAQMYPLQEIQDLTVKLQLQALQQNGSCVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPTGPLPAHLLGDMWGRFWTNLYSLTVPFGQKPNIDVTDAMVDQAWDAQRIFKEAEKFFVSVGLPNMTQGFWENSMLTDPGNGQKVVCYPTAWDLGKGDFRILMCTKVTMDDFLTAHHEMGHIQYDMAYLAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKIRLSLKSALGDKAYEWNDNEMYLFRSSVAYVMRQYFSKVKNQMIGFGEEDVRVANLKPRISFNFFLTAPKNVSDITPRTEVEKAIRMSRSRINDCFRLNDNSLEFLGIQPTLGPPNQPPVSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSPGK

SEQ ID NO: 67 - DNA, 3341 bp, Artificial Sequence
  Description of Artificial Sequence: Synthetic polynucleotide
gagctcacttagtgaactgtcagatcacctggagacacatccacactgttttgacctccatagcagacaccaggaccaatccagcctcaagacagattcaggaactgaaaaaccagaaagttaacaggtaagtttaaagctcagggcaagactgggcctttgcctgggtctggtggtggtgcaaatcaaagaactgctcctcacatttttttccttttcttccaggcctgtaaggaagtgttacttctactctaaaagctgaggaattgtagagctagcagccaccatgagcagcagtagctggctgctcctgagccttgtggctgtaacagcagcccagagcaccattgaagagcaggccaagaccttcctggacaagttcaaccatgaagctgaagacctgttctaccagagcagcctggccagctggaactacaacaccaacatcacagaggagaatgtgcagaacatgaacaatgctggagacaagtggagtgcattcctgtgtgagcagagcacactggcccagatgtacccactgcaggagatccagaacctgacagtgaagctgcagctgcaggcactgcagcagaatggcagctgtgtactgtctgaagacaagagcaagagactgaatacaattctgaacacaatgagcacaatctacagcacaggcaaagtgtgcaatccagacaatcctcaggagtgcctgctgctggaacctggcctgaatgagatcatggccaatagcctggactacaatgaaagactgtgggcctgggaaagctggagaagtgaagtgggcaagcagctgagaccactgtatgaggaatatgtagtgctgaagaatgagatggccagagccaaccactatgaagactatggagactactggagaggagactatgaagtcaatggagtagatggctatgactacagtagaggccagctcattgaagatgtagagcatacctttgaagaaatcaagccactgtatgagcacctccatgcatatgtaagagccaagctgatgaatgcatatccaagctacattagcccaattggatgcctgcctgcacacctgctgggagacatgtggggaagattctggacaaacctgtactccctgactgtgccatttggccaaaaacccaacattgatgtcactgatgccatggtagaccaggcctgggatgcacagagaatcttcaaagaagctgaaaaattctttgtatcagtgggcctgccaaacatgacacaaggattctgggaaaatagtatgctgacagatccaggcaatgtccagaaagtagtctgccatccaacagcatgggatctgggaaaaggagacttcagaatcctgatgtgcaccaaagtgaccatggatgacttcctgactgcacaccatgagatgggacacatccagtatgacatggcatatgcagcccagccattcctgctgagaaatggagccaatgaaggcttccatgaagcagtgggagagatcatgagcctgagtgcagccacacccaagcacctgaagagcattggcctgctgagccctgacttccaggaagacaatgagactgagatcaacttcctgctgaagcaagcactgaccattgtaggcacactgccattcacctacatgctggagaaatggagatggatggtgttcaaaggagagatcccaaaggatcagtggatgaagaaatggtgggaaatgaaaagagaaattgtaggagtagtagagcctgtcccacatgatgagacctactgtgatcctgcaagcctgttccatgtgtccaatgactacagcttcattagatactacactagaaccctgtaccagttccaattccaagaagcactgtgccaggcagccaagcatgaaggaccactgcacaaatgtgacatctccaatagcacagaagcaggccagaagctgttcaacatgctgagactgggcaagagtgagccatggaccctggcactggagaatgtagtaggagcaaaaaacatgaatgtaagaccactgctgaactactttgaaccactgttcacatggctgaaagaccaaaacaagaattcatttgtaggatggagcacagactggagcccatatgctgatcaaagcatcaaagtcagactgtcactaaaatcagcactaggagacaaagcctatgaatggaatgacaatgagatgtacctgtttagaagctctgtagcctatgccatgagacaatacttcctgaaagtcaaaaaccagatgatcctgtttggagaagaagatgtcagagtagccaatctgaagcctagaatcagcttcaacttctttgtaactgcacctaagaatgtatcagacatcactccaagaacagaagtagaaaaagccatcagaatgagcagaagcagaatcaatgactgcttcagactgaatgacaacagcctggagttcctgggaatccagcctacactgggaccaccaaaccaaccaccagtagaatgtccaccatgtccagcaccaccagtagcaggaccaagtgtattcctattcccaccaaagccaaaagacacactaatgatatctagaacacctgaagtgacctgtgtagtagtagatgtatcccatgaagaccctgaagtccaattcaattggtatgtggatggagtggaagtacacaatgccaagaccaaaccaagagaagagcaattcaatagcacattcagagtagtatctgtactcactgtagtgcaccaagactggctcaatggcaaagaatacaaatgcaaagtgtccaacaaaggactccctgcaccaattgaaaagactatctccaagaccaaaggacaaccaagagagccacaagtctacacactgccaccaagtagagaagagatgaccaagaaccaagtatcactgacatgccttgtcaaaggattctaccctagtgacattagtgtagaatgggaaagtaatggacaacctgaaaacaactacaagacaacaccaccaatgctggatagtgatggcagcttcttcctgtactcaaaactgactgtagacaaaagtagatggcaacaaggaaatgtgtttagctgttctgtactgcatgaagcactgcacagccactacacacaaaaaagcctgagtctgagccctggcaagtgataggatccagatctgctgtgccttctagttgcagccatctgttgtttgcccctcccccgtgccttccttgaccctggaagtgccactcccactgtcctttcctaataaaagaggaaattgcatcgcattgtctgagtagtgtcattctattctggggggtggggtgggg

SEQ ID NO: 68 - DNA, 3565 bp, Artificial Sequence
  Description of Artificial Sequence: Synthetic polynucleotide
gagctcacttagtgaactgtcagatcacctggagacacatccacactgttttgacctccatagcagacaccaggaccaatccagcctcaagacagattcaggaactgaaaaaccagaaagttaacaggtaagtttaaagctcagggcaagactgggcctttgcctgggtctggtggtggtgcaaatcaaagaactgctcctcacatttttttccttttcttccaggcctgtaaggaagtgttacttctactctaaaagctgaggaattgtagagctagcagccaccatgagcagcagtagctggctgctcctgagccttgtggctgtaacagcagcccagagcaccattgaagagcaggccaagaccttcctggacaagttcaaccatgaagctgaagacctgttctaccagagcagcctggccagctggaactacaacaccaacatcacagaggagaatgtgcagaacatgaacaatgctggagacaagtggagtgcattcctgtgtgagcagagcacactggcccagatgtacccactgcaggagatccagaacctgacagtgaagctgcagctgcaggcactgcagcagaatggcagctgtgtactgtctgaagacaagagcaagagactgaatacaattctgaacacaatgagcacaatctacagcacaggcaaagtgtgcaatccagacaatcctcaggagtgcctgctgctggaacctggcctgaatgagatcatggccaatagcctggactacaatgaaagactgtgggcctgggaaagctggagaagtgaagtgggcaagcagctgagaccactgtatgaggaatatgtagtgctgaagaatgagatggccagagccaaccactatgaagactatggagactactggagaggagactatgaagtcaatggagtagatggctatgactacagtagaggccagctcattgaagatgtagagcatacctttgaagaaatcaagccactgtatgagcacctccatgcatatgtaagagccaagctgatgaatgcatatccaagctacattagcccaattggatgcctgcctgcacacctgctgggagacatgtggggaagattctggacaaacctgtactccctgactgtgccatttggccaaaaacccaacattgatgtcactgatgccatggtagaccaggcctgggatgcacagagaatcttcaaagaagctgaaaaattctttgtatcagtgggcctgccaaacatgacacaaggattctgggaaaatagtatgctgacagatccaggcaatgtccagaaagtagtctgccatccaacagcatgggatctgggaaaaggagacttcagaatcctgatgtgcaccaaagtgaccatggatgacttcctgactgcacaccatgagatgggacacatccagtatgacatggcatatgcagcccagccattcctgctgagaaatggagccaatgaaggcttccatgaagcagtgggagagatcatgagcctgagtgcagccacacccaagcacctgaagagcattggcctgctgagccctgacttccaggaagacaatgagactgagatcaacttcctgctgaagcaagcactgaccattgtaggcacactgccattcacctacatgctggagaaatggagatggatggtgttcaaaggagagatcccaaaggatcagtggatgaagaaatggtgggaaatgaaaagagaaattgtaggagtagtagagcctgtcccacatgatgagacctactgtgatcctgcaagcctgttccatgtgtccaatgactacagcttcattagatactacactagaaccctgtaccagttccaattccaagaagcactgtgccaggcagccaagcatgaaggaccactgcacaaatgtgacatctccaatagcacagaagcaggccagaagctgttcaacatgctgagactgggcaagagtgagccatggaccctggcactggagaatgtagtaggagcaaaaaacatgaatgtaagaccactgctgaactactttgaaccactgttcacatggctgaaagaccaaaacaagaattcatttgtaggatggagcacagactggagcccatatgctgatcaaagcatcaaggtaagttgaaagctcagggggagactgggcctttgtctggggctcccttggagcctacctagactcagctggctctccaggctttgcctgaccctgcttgctcaactctagttaactgtggagggcagtgtagtctgagcagtacttgttgctgctgggggggccaccagacataatagctgacagactaacagactgttcctttccttttttctttcctgcaggtaagactgtcactaaaatcagcactaggagacaaagcctatgaatggaatgacaatgagatgtacctgtttagaagctctgtagcctatgccatgagacaatacttcctgaaagtcaaaaaccagatgatcctgtttggagaagaagatgtcagagtagccaatctgaagcctagaatcagcttcaacttctttgtaactgcacctaagaatgtatcagacatcactccaagaacagaagtagaaaaagccatcagaatgagcagaagcagaatcaatgactgcttcagactgaatgacaacagcctggagttcctgggaatccagcctacactgggaccaccaaaccaaccaccagtagaatgtccaccatgtccagcaccaccagtagcaggaccaagtgtattcctattcccaccaaagccaaaagacacactaatgatatctagaacacctgaagtgacctgtgtagtagtagatgtatcccatgaagaccctgaagtccaattcaattggtatgtggatggagtggaagtacacaatgccaagaccaaaccaagagaagagcaattcaatagcacattcagagtagtatctgtactcactgtagtgcaccaagactggctcaatggcaaagaatacaaatgcaaagtgtccaacaaaggactccctgcaccaattgaaaagactatctccaagaccaaaggacaaccaagagagccacaagtctacacactgccaccaagtagagaagagatgaccaagaaccaagtatcactgacatgccttgtcaaaggattctaccctagtgacattagtgtagaatgggaaagtaatggacaacctgaaaacaactacaagacaacaccaccaatgctggatagtgatggcagcttcttcctgtactcaaaactgactgtagacaaaagtagatggcaacaaggaaatgtgtttagctgttctgtactgcatgaagcactgcacagccactacacacaaaaaagcctgagtctgagccctggcaagtgataggatccagatctgctgtgccttctagttgcagccatctgttgtttgcccctcccccgtgccttccttgaccctggaagtgccactcccactgtcctttcctaataaaagaggaaattgcatcgcattgtctgagtagtgtcattctattctggggggtggggtgggg

SEQ ID NO: 69 - protein, 805 aa, Pan troglodytes
MSGSSWLLLSLVAVTAAQSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSAIYSTGKVCNPNNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPEDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRKSRSRINDAFRLNDNSLEFLGIQPTLGPPNQPPVSIWLIVFGVVMGVIVVGIVILIFTGIRDRKKKNKARSEENPYASVDTSKGENNPGFQNTDDVQTSF

SEQ ID NO: 70 - protein, 805 aa, Pan paniscus
MSGSSWLLLSLVAVTAAQSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSAIYSTGKVCNPNNPQECLLLEPGLNEIMANSLDYNERLWAWESWRSEVGKQLRPLYEEYVVLKNEMARANHYEDYGDYWRGNYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRKSRSRINDAFRLNDNSLEFLGIQPTLGPPNQPPVSIWLIVFGVVMGVIVVGIVILIFTGIRDRKKKNKARSEENPYASVDTSKGENNPGFQNTDDVQTSF

SEQ ID NO: 71 - protein, 805 aa, Gorilla gorilla
MSGSSWLLLSLVAVTAAQSTIEEQAKTFLDKFNHEAEDLFYQSSLASWNYNTNITEENVQNMNNAGDKWSAFLKEQSTLAQMYPLQEIQNLTIKLQLQALQQNGSSVLSEDKSKRLNTILNTMSTIYSTGKVCNPNNPQECLLLEPGLNEIMANSLDYSERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLEVKKQMILFGEEDVRVANLKPRISFNFFVTAPKNVSDIIPRTEVEKAIRMSRGRINDAFRLNDNSLEFLGIQPTLGPPNQPPVSIWLIVFGVVMGVIVVGIVILIFTGIRDRKKKNKARSEENPYASIDISKGENNPGFQNTDDVQTSF

SEQ ID NO: 72 - protein, 805 aa, Nomascus leucogenys
MSGSSWLLLSLVAVTAAQSTIEEQARTFLDKFNHEAEDLFYQSSLASWNYNTNITEENVQNMNNAGDKWSAFLKEQSTLAQMYPLQEIQNLTIKLQLQALQQNGSSVLSEDKSKRLNTILNTMSTIYSTGKVCNPNNPQECLLLEPGLNEIMANSLDYSERLWAWESWRSEVGKQLRPLYEEYVVLKNEMARANYYEDYGDYWRGDYEVNGVDGYDYSRGQLIEDVEHTFEEIKPLYEHLHAYVRAKLINAYPSYISPIGCLPAHLLGDMWGRFWTNLYSLTVPFGQKPNIDVTDAMVDQAWDAQRIFKEAEKFFVSVGLPNMTQGFWENSMLTDPGNVQKVVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLLNMLRLGKSEPWTLALENVVGAKNMNVRPLLNYFEPLFTWLKDQNKNSFVGWSTDWSPYADQSIKVRISLKSALGDEAYEWNDNEMYLFRSSVAYALRKYFLKVKNQMILFGEEDVRVANLKPRISFNFFVTAPKNVSDIIPRTEVEKAIRMSRSRINDAFRLNDNSLEFLGIQPTLGPPNQPTVTIWLIVFGVVTGVIVVGIVILIFTGIRDRKKKNKARSEENPYASVDISKGENNPGFENTDDVQTSF

SEQ ID NO: 73 - protein, 805 aa, Pongo abelii
MSGSSWLLLSLVAVTAAQSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPNNPQECLLLEPGLNEIMANSLDYNERLWAWESWRSEVGKQLRPLYEEYVVLKNEMARANHYEDYGDYWRGDYEVNGVDSYDYSRGQLIEDVEHTFEEIKPLYEHLHAYVRAKLINAYPSYISPIGCLPAHLLGDMWGRFWTNLYSLTVPFGQKPNIDVTDAMVDQAWDAQRIFKEAEKFFVSVGLPNMTQRFWENSMLTDPGNVQKVVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLLNMLRLGKSEPWTLALENVVGAKNMNVRPLLNYFEPLFTWLKDQNKNSFVGWSTDWSPYADQSIKVRISLKSALGNKAYEWNDNEMYLFRSSVAYAMRKYFLEVKNQMILFGEEDVRVANLKPRISFNFFVTAPKNVSDIIPRTEVEKAIRMSRSRINDAFRLNDNSLEFLGIQPTLGPPNQPPVSIWLIVFGVVMGVIVVGIVVLIFTGIRDRKKKNKARNEENPYASIDISKGENNPGFQNTDDVQTSF

SEQ ID NO: 74 - protein, 805 aa, Piliocolobus tephrosceles
MSGSSWLLFSLVAVTAAQSTIEEQAKTFLDKFNHEAEDLFYQSSLASWNYNTNITEENAQNMNNAGEKWSAFLKEQSTLAQMYPLQEIQNLTVKLQLQALQQNGSSVLSEDKSKRLNTILNTMSTIYSTGKVCNPNNPQECLLLDPGLNEIMEKSLDYNERLWAWEGWRSEVGKQLRPLYEEYVVLKNEMARANHYKDYGDYWRGDYEANGVDGYDYNRDQLIEDVEHTFEEIKPLYEHLHAYVRAKLMNAYPSYISPTGCLPAHLLGDMWGRFWTNLYSLTVPFGQKPNIDVTDAMVNQAWNAQRIFKEAEKFFVSVGLPNMTQGFWENSMLTDPGDVQKVVCHPTAWDLGKGDFRILMCTKVTMDDFLTAHHEMGHIQYDMAYAAQPFLLRSGANEGFHEAVGEIMSLSAATPKHLKSIGLLSPDFQEDNETEINFLLKQALTIVGTLPFTYMLEKWRWMVFEGEIPKDQWMKKWWEMKREIVGVVEPVPHDETYCDPASLFHVSNDYSFIRYYTRTLYQFQFQEALCQAAKHEGPLHKCDISNSTEAGQKLLNMLKLGKSEPWTLALENVVGAKNMNVRPLLNYFEPLFTWLKDQNKNSFVGWSTDWSPYADQSIKVRISLKSALGDKAYEWNDNEMYLFRSSVAYAMRKYFLEIKHQTILFGEEDVRVADLKPRISFNFYVTAPKNVSDIIPRTEVEEAIRLSRSRINDAFRLNDDSLEFLGIQPTLAPPYQPPVTIWLIVFGVVMGVIVAGTVVLIFTGIRDRKKKNQARSEENPYASIDISKGENNPGFQNTDDVQTSF

SEQ ID NO: 75 - protein, 805 aa, Rhinopithecus roxellana
MSGSSWLLLSLVAVTAAQSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPNNSQECLLLDPGLNEIMEKSLDYNERLWAWEGWRSEVGKQLRPLYEEYVVLKNEMARANHYKDYGDYWRGDYEVNGVDGYDYNRDQLIEDVEHTFEEIKPLYEHLHAYVRAKLMNAYPSYISPTGCLPAHLLGDMWGRFWTNLYSLTVPFGQKPNIDVTDAMVNQAWNAQRIFKEAEKFFVSIGLPNMTRGFWENSMLTDPGNVQKVVCHPTAWDLGKGDFRIIMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFHEALCQAAKHEGPLHKCDISNSTEAGQKLLNMLKLGKSEPWTLALENVVGAKNMNVRPLLNYFEPLFTWLKDQNKNSFVGWSTDWSPYADQSIKVRISLKSALGDKAYEWNDNEMYLFRSSVAYAMRKYFLEIKHQTILFGEEDVRVADFKPRISFNFYVTAPKNVSDIIPRTEVEEAIRISRSRINDAFRLNDNSLEFLGIQPTLAPPYQPPVTIWLIVFGVVMGVIVAGIVVLIFTGIRDRKKKNQARSEENPYASIDISQGENNPGFQNTDDVQTSF

SEQ ID NO: 76 - protein, 724 aa, Rhinopithecus bieti
MYPLQEIQNLTVKLQLQALQQNGSSVLSEDKSKRLNTILNTMSTIYSTGKVCNPNNSQKCLLLDPGLNEIMEKSLDYNERLWAWEGWRSEVGKQLRPLYEEYVVLKNEMARANHYKDYGDYWRGDYEANGVDGYDYNRDQLIEDVEHTFEEIKPLYEHLHAYVRAKLMNAYPSYISPTGCLPAHLLGDMWGRFWTNLYSLTVPFGQKPNIDVTDAMVNQAWNAQRIFKEAEKFFVSIGLPNMTRGFWENSMLTDPGNVQKVVCHPTAWDLGKGDFRIIMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFHEALCQAAKHEGPLHKCDISNSTEAGQKLLNMLKLGKSEPWTLALENVVGAKNMNVRPLLNYFEPLFTWLKDQNKNSFVGWSTDWSPYADQSIKVRISLKSALGDKAYEWNDNEMYLFRSSVAYAMRKYFLEIKHQTILFGEEDVRVADLKPRISFNFYVTAPKNVSDIIPRTEVEEAIRISRSRINDAFRLNDNSLEFLGIQPTLAPPYQPPVTIWLIVFGVVMGVIVAGIVVLIFTGIRDRKKKNQARSEENPYASIDISQGENNPGFQNTDDVQTSF

SEQ ID NO: 77 - protein, 805 aa, Chlorocebus sabaeus
MSGSSWLLLSLVAVTAAQSTIEEQAKTFLDKFNHEAEDLFYQSSLASWNYNTNITEENVQNMNNAGEKWSAFLKEQSTLAQMYPLQAIQNLTVKLQLQALQQNGSSVLSEDKSKRLNTILNTMSTIYSTGKVCNPNNPQECLLLDPGLNEIMEKSLDYNERLWAWEGWRSEVGKQLRPLYEEYVVLKNEMARANHYKDYGDYWRGDYEVNGVDGYDYNRDQLIEDVERTFEEIKPLYEHLHAYVRAKLMNAYPSYISPTGCLPAHLLGDMWGRFWTNLYSLTVPFGQKPNIDVTDAMVNQAWNAQRIFKEAEKFFVSVGLPNMTQGFWENSMLTDPGNVQKVVCHPTAWDLGKGDFRIIMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLLNMLKLGKSEPWTLALENVVGAKNMNVRPLLNYFEPLFTWLKDQNKNSFVGWSTDWSPYADQSIKVRISLKSALGANAYKWNDNEMYLFRSSVAYAMRQYFLENKHQTILFGEEDVRVADLKPRISFNFYVTAPKNVSDIIPRTEVEEAIRFSRSRINDAFQLNDNSLEFLGIQSTLIPPYQSPVTTWLIVFGVVMAVIVAGIVVLIFTGIRDRKKKNQARSEENPYASIDISKGENNPGFQNTDDVQTSF

SEQ ID NO: 78 - protein, 805 aa, Cercocebus atys
MSGSSWLLLSLVAVTAAQSTIEEQAKTFLDKFNHEAEDLFYQSSLASWNYNTNITEENVQNMNNAGEKWSAFLKEQSALAQMYPLQEIQNLTVKLQLQALQQNGSSVLSEDKSKRLNTILNTMSTIYSTGKVCNPNNPQECLLLDPGLNEIMEKSLDYNERLWAWEGWRSEVGKQLRPLYEEYVVLKNEMARANHYKDYGDYWRGDYEVNGVDGYDYTRDQLIEDVERTFEEIKPLYEHLHAYVRAKLMNAYPSYISPTGCLPAHLLGDMWGRFWTNLYSLTVPFGQKPNIDVTDAMVNQAWNAQRIFKEAEKFFVSVGLPNMTQGFWENSMLTDPGNVQKVVCHPTAWDLGKGDFRIIMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLLNMLKLGKSEPWTLALENVVGAKNMNVRPLLNYFEPLFTWLKDQNKNSFVGWSTDWSPYADQSIKVRISLKSALGDKAYEWNDNEMYLFRSSVAYAMRKYFLERKHQTILFGEEDVRVADLKPRISFNFYVTAPKNVSDIIPRTEVEEAIRNSRSRINDAFRLNDNSLEFLGIQTTLAPPYQSPVTTWLIVFGVVMGVIVAGIVVLIFTGIRDRKKKNQARSEENPYASIDISEGENNPGFQNTDDVQTSF

SEQ ID NO: 79 - protein, 805 aa, Mandrillus leucophaeus
MSGSSWLLLSLVAVTAAQSTIEEQAKTFLDKFNHEAEDLFYQSSLASWNYNTNITEENVQNMNNAGEKWSAFLKEQSALAQMYPLQEIQNLTVKLQLQALQQNGSSVLSEDKSKRLNTILNTMSTIYSTGKVCNPNNPQECLLLDPGLNEIMEKSLDYNERLWAWEGWRSEVGKQLRPLYEEYVVLKNEMARANHYKDYGDYWRGDYEVNGVDGYDYNRDQLIEDVERTFEEIKPLYEHLHAYVRAKLMNAYPSYISPTGCLPAHLLGDMWGRFWTNLYSLTVPFGQKPNIDVTDAMVNQAWNAQRIFKEAEKFFVSVGLPNMTQGFWENSMLTDPGNVQKVVCHPTAWDLGKGDFRIIMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHTCDISNSTEAGQKLLNMLKLGKSEPWTLALENVVGAKNMNVRPLLNYFEPLFTWLKDQNKNSFVGWSTDWSPYADQSIKVRISLKSALGDKAYEWNDNEMYLFRSSVAYAMRKYFLERKHQTILFGEEDVRVADLKPRISFNFYVTAPKNVSDIIPRTEVEEAIRNSRSRINDAFRLNDNSLEFLGIPTTLAPPYQSPVTTWLIVFGVVMGVIVAGIVVLIFTGIRDRKKKNQARSEENPYASIDISEGENNPGFQNTDDVQTSF

SEQ ID NO: 80 - protein, 805 aa, Macaca mulatta
MSGSSWLLLSLVAVTAAQSTIEEQAKTFLDKFNHEAEDLFYQSSLASWNYNTNITEENVQNMNNAGEKWSAFLKEQSTLAQMYPLQEIQNLTVKLQLQALQQNGSSVLSEDKSKRLNTILNTMSTIYSTGKVCNPNNPQECLLLDPGLNEIMEKSLDYNERLWAWEGWRSEVGKQLRPLYEEYVVLKNEMAGANHYKDYGDYWRGDYEVNGVDGYDNNRDQLIEDVERTFEEIKPLYEHLHAYVRAKLMNAYPSYISPTGCLPAHLLGDMWGRFWTNLYSLTVPFGQKPNIDVTDAMVNQAWNAQRIFKEAEKFFVSVGLPNMTQGFWENSMLTDPGNVQKVVCHPTAWDLGKGDFRIIMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLLNMLKLGESEPWTLALENVVGAKNMNVRPLLNYFEPLFTWLKDQNKNSFVGWSTDWSPYADQSIKVRISLKSALGDKAYEWNDNEMYLFRSSVAYAMRTYFLEIKHQTILFGEEDVRVADLKPRISFNFYVTAPKNVSDIIPRTEVEEAIRISRSRINDAFRLNDNSLEFLGIQTTLAPPYQSPVTTWLIVFGVVMGVIVAGIVVLIFTGIRDRKKKNQARSEENPYASIDINKGENNPGFQNTDDVQTSF

SEQ ID NO: 81 - protein, 805 aa, Macaca nemestrina
MSGSSWLLLSLVAVTAAQSTIEEQAKTFLDKFNHEAEDLFYQSSLASWNYNTNITEENVQNMNNAGEKWSAFLKEQSTLAQMYPLQEIQNLTVKLQLQALQQNGSSVLSEDKSKRLNTILNTMSTIYSTGKVCNPNNPQECLLLDPGLNEIMEKSLDYNERLWAWEGWRSEVGKQLRPLYEEYVVLKNEMARANHYKDYGDYWRGDYEVNGVDGYDYNRDQLIEDVERTFEEIKPLYEHLHAYVRAKLMNAYPSYISPTGCLPAHLLGDMWGRFWTNLYSLTVPFGQKPNIDVTDAMVNQAWNAQRIFKEAEKFFVSVGLPNMTQGFWENSMLTDPGNVQKVVCHPTAWDLGKGDFRIIMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLLNMLKLGKSEPWTLALENVVGAKNMNVRPLLNYFEPLFTWLKDQNKNSFVGWSTDWSPYADQSIKVRISLKSALGDKAYEWNDNEMYLFRSSVAYAMRTYFLEIKHQTILFGEEDVRVADLKPRISFNFYVTAPKNVSDIIPRTEVEEAIRISRSRINDAFRLNDNSLEFLGIQTTLAPPYQSPVTTWLIVFGVVMGVIVAGIVVLIFTGIRDRKKKNQARSEENPYASIDINKGENNPGFQNTDDVQTSF

SEQ ID NO: 82 - protein, 805 aa, Macaca fascicularis
MSGSSWLLLSLVAVTAAQSTIEEQAKTFLDKFNHEAEDLFYQSSLASWNYNTNITEENVQNMNNAGEKWSAFLKEQSTLAQMYPLQEIQNLTVKLQLQALQQNGSSVLSEDKSKRLNTILNTMSTIYSTGKVCNPNNPQECLLLDPGLNEIMEKSLDYNERLWAWEGWRSEVGKQLRPLYEEYVVLKNEMARANHYKDYGDYWRGNYEVNGVDGYDYNRDQLIEDVERTFEEIKPLYEHLHAYVRAKLMNAYPSYISPTGCLPAHLLGDMWGRFWTNLYSLTVPFGQKPNIDVTDAMVNQAWNAQRIFKEAEKFFVSVGLPNMTQGFWENSMLTDPGNVQKVVCHPTAWDLGKGDFRIIMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLLNMLKLGKSEPWTLALENVVGAKNMNVRPLLNYFEPLFTWLKDQNKNSFVGWSTDWSPYADQSIKVRISLKSALGDKAYEWNDNEMYLFRSSVAYAMRTYFLEIKHQTILFGEEDVRVADLKPRISFNFYVTAPKNVSDIIPRTEVEEAIRISRSRINDAFRLNDNSLEFLGIQTTLAPPYQSPVTTWLIVFGVVMGVIVAGIVVLIFTGIRDRKKKNQARSEENPYASIDINKGENNPGFQNTDDVQTSF

SEQ ID NO: 83 - protein, 805 aa, Theropithecus gelada
MSGSSWLLLSLVAVTAAQSTIEEQAKTFLDKFNHEAEDLFYQSSLASWNYNTNITEENVQNMNNAGEKWSAFLKEQSALAQMYPLQEIQNLTVKLQLQALQQNGSSVLSEDKSKRLNTILNTMSTIYSTGKVCNPNNPQECLLLDPGLNEIMEKSLDYNERLWAWEGWRSEVGKQLRPLYEEYVVLKNEMARANHYKDYGDYWRGDYEVNGVDGYDYNRDQLIEDVERTFEEIKPLYEHLHAYVRAKLMNAYPSYISPTGCLPAHLLGDMWGRFWTNLYSLTVPFGQKPNIDVTDAMVNQAWNAQRIFKEAEKFFVSVGLPNMTQGFWENSMLTDPGNVQKVVCHPTAWDLGKGDFRIIMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLLNMLKLGKSEPWTLALENVVGAKNMNVRPLLNYFEPLFTWLKDQNKNSFVGWSTDWSPYADQSIKVRISLKSALGDKAYEWNDNEMYLFRSSVAYAMRKYFLELKHQTILFGEEDVRVADLKPRISFNFYVTAPKNVSDIIPRTEVEEAIRISRSRINDAFRLNDNSLEFLGIEPTLAPPYQSPVTTWLIVFGVVMGVIVAGIVVLIFTGIRDRKKKNQARSEENPYASIDISKGENNPGFQNTDDVQTSF

SEQ ID NO: 84 - protein, 805 aa, Papio anubis
MSGSSWLLLSLVAVTAAQSTIEEQAKTFLDKFNHEAEDLFYQSSLASWNYNTNITEENVQNMNNAGEKWSAFLKEQSALAQMYPLQEIQNLTVKLQLQALQQNGSSVLSEDKSKRLNTILNTMSTIYSTGKVCNPSNPQECLLLDPGLNEIMEKSLDYNERLWAWEGWRSEVGKQLRPLYEEYVVLKNEMARANHYKDYGDYWRGDYEVNGVDGYDYNRDQLIEDVERTFEEIKPLYEHLHAYVRAKLMNAYPSYISPTGCLPAHLLGDMWGRFWTNLYSLTVPFGQKPNIDVTDAMVNQAWNAQRIFKEAEKFFVSVGLPNMTQGFWENSMLTDPGNVQKVVCHPTAWDLGKGDFRIIMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLLNMLKLGKSEPWTLALENVVGAKNMNVRPLLNYFEPLFTWLKDQNKNSFVGWSTDWSPYADQSIKVRISLKSALGDKAYEWNDNEMYLFRSSVAYAMRTYFLEIKHQTILFGEEDVRVADLKPRISFNFYVTAPKNVSDIIPRTEVEEAIRISRSRINDAFRLNDNSLEFLGIEPTLAPPYQSPVTTWLIVFGVVMGVIVAGIVVLIFTGIRDRKKKNQARSEENPYASIDISKGENNPGFQNTDDVQTSF

SEQ ID NO: 85 - protein, 804 aa, Callithrix jacchus
SGSFWLLLSLVAVTAAQSTIEEQAKTFLDKFNHEAEDLFHENSLASWNYNTNITEENVQNMNVAGEKWFAFFKEQSKLAQTYPLQEIQNLTVKLQLQALQQNGSSVLSEDKSQQLNIIINTMSTIYSTGKVCKPNYPQECLLLEPDLNEIMAKSTDYNERLWAWESWRSEIGKQLRPLYEEYVVLKNEMARANHYEDYGDYWRGDYEVNGVDGYDYYRNQLIEDVERTFEEIKPLYEHLHAYVRTKLMNAYPSYISPTGCLPAHLLGDMWGRFWTNLYSLTVPFGQKPNIDVTDEMVKQAWDAQRIFKEAEKFFASVGLPNMTQGFWENSMLTEPGDGQKVVCHPTAWDLGKQDFRILMCTKTTMDDFLTAHHEMGHIQYDMAYAAQPFLLRNGANEGFHEAVGEIMSLSAATPKHLKSIGLLSPDFQEDSETEINFLLKQALTIVGTLPFTYMLEKWRWMVFKGEIPKEQWMKKWWEMKREIVGVVEPVPHDETYCDPASLFHVSNDYSFIRYYTRTLYQFQFQEALCQAAKHEGPLHKCDISSSTEAGQKLLNMLRLGKSEPWTLALENVVGAKNMDVRPLLNYFEPLFTWLKDQNKNSFVGWSTNWSPYTDQSIKVRISLKSALGDQAYKWNDNEMYLFRSSVAYAMREYFLKVKNQMIPFGEEDVRVADLKPRISFNFFVTAPQNVSDIIPRIEVEKAISMSRSRINDAFGLNDNSLEFLGIQPTLEPPYQPPITIWLIVFGVVMGMVVVGIVILIITGIRDRKKKNEARSEENPYASIDFGKGEDNPGFQNSEEVQTSF

SEQ ID NO: 86 - protein, 805 aa, Saimiri boliviensis
MSGSFWLLLSLVAVIAAQSTIEEQAKTFLDKFNHEAEDLFHENSLASWNYNTNITEENVQNMNVAGEKWSAFFKEQSKLAQTYPLQEIQNLTVKLQLQALQQNGSSVLSEDKSKRLNIIINAMSTIYSTGKVCNPNHPQECLLLEPGLNEIMAKSTDYNERLWAWEGWRSEVGKQLRPLYEEYVVLKNEMARANHYEDYGDYWRGDYEVNGVDGYDYHRNQLIEDVERTFEEIKPLYEHLHAYVRAKLMNAYPSYISPIGCLPAHLLGDMWGRFWTNLYSLTVPYGQKPNIDVTDEMVNQAWDARRIFKEAEKFFASVGLPNMTQGFWENSMLTEPGDGQKVVCHPTAWDLGKQDFRILMCTKTTMDDFLTAHHEMGHIQYDMAYAAQPFLLRNGANEGFHEAVGEIMSLSAATPKHLKSIGLLSPDFQEDSETEINFLLKQALTIVGTLPFTYMLEKWRWMVFMGEIPKEQWMKKWWEMKREIVGVVEPVPHDETYCDPASLFHVSNDYSFIRYYTRTLYQFQFQEALCQAAKHEGPLHKCDISSSTEAGQKLLNMLRLGKSEPWTLALENVVGAKNMDVRPLLNYFEPLFTWLKDQNKNSFVGWITNWSPYTDQRIKVRISLKSALGDQAYEWNDNEMYLFRSSVAYAMRKYFLKVKNQTIPFGEEDVRVADLKPRISFNFFVTAPQNVSDIIPRIEVEEAIRMSRSRINDAFHLNDNSLEFLGIQPTLGPPYQPPVTIWLIVFGVVMGMVAVGIVILIITGIRDRKKKNEARSEENPYASIDIGKGEDNPGFQNSDEVQTSF

SEQ ID NO: 87 - protein, 805 aa, Aotus nancymai
MSGSFWLLLSLVAVTAAQSTIEEQAKTFLDKFNHEAEDLFHENSLASWNYNTNITEENVQNMNVAGEKWSDFFKEQSKLAQTYPLQEIQNLTVKLQLQALQQNGSSVLSEDKSKRLNTIINTMSTIYSIGKVCNPNYPQECLLLEPGLNEIMAKSTDYNERLWAWEGWRSEIGKQLRPLYEEYVVLKNEMARANHYEDYGDYWRGDYEVNGVDGYDYYRNQLIEDVERTFEEIKPLYEHLHAYVRAKLMNAYPSYISPTGCLPAHLLGDMWGRFWTNLYSLTVPFGQKPNIDVTDEMVKQAWDAQRIFKEAEKFFASVGLPNMTQGFWENSMLTEPGDGQKVVCHPTAWDLGKQDFRILMCTKTTMDDFLTAHHEMGHIQYDMAYAAQPFLLRNGANEGFHEAVGEIMSLSAATPKHLKSIGLLSPDFQEDSETEINFLLKQALTIVGTLPFTYMLEKWRWMVFKGEIPKEQWMKKWWEMKREIVGVVEPVPHDETYCDPASLFHVSNDYSFIRYYTRTLYQFQFQEALCQAAKHEGPLHKCDISSSTEAGQKLLNMLRLGKSEPWTLALENVVGAKNMDVRPLLNYFEPLFTWLKDQNKNSFVGWSTSWSPYTDQSIKVRISLKSALGDQAYEWNDNEMYLFRSSIAYAMREYFFKVKNQTIPFGEEDVRVADLKPRISFNFFVTAPQNVSDIIPRIEVEEAIRMSRSRINDAFRLNDNSLEFLGIQPTLGPPYQSPVTIWLIVFGVVMGMVVVGIVILIITGIRDRKKKNEARSEENPYADIDIDKGEDNPGFENSDEVQTSF

SEQ ID NO: 88 - protein, 805 aa, Cebus imitator
  MOD_RES (515)..(515): Any amino acid
MSGSFWLLLSLVAVTAAQSTIEEQAKTFLDKFNHEAEDLFHENSLASWNYNTNITEENVQNMNVAGEKWSAFFKEQSKLAQTYPLKEIQNLTVKLQLQALQQNGSSVLSEDKSKRLNTIINTMSTIYSTGKVCNPNYPQECLLLEPGLNEIMAKSTDYNERLWAWEGWRSEVGKQLRPLYEEYVVLKNEMARANHYEDYGDYWRGDYEVNGVDGYDYYRNQLIEDVERTFEEIKPLYEHLHAYVRAKLMNVYPSYISPTGCLPAHLLGDMWGRFWTNLYSLTVPFGQKPNIDVTDEMVKQAWDARRIFKEAEKFFASVGLPNMTQGFWENSMLTEPGDGQKVVCHPTAWDLGKQDFRILMCTKTTMDDFLTAHHEMGHIQYDMAYAAQPFLLRNGANEGFHEAVGEIMSLSAATPKHLKSIGLLSPDFQEDSETEINFLLKQALTIVGTLPFTYMLEKWRWMVFKGEIPKEQWMKKWWEMKREIVGVVEPVPHDETYCDPASLFHVSNDYSFIRXYTRTLYQFQFQEALCQAAKHEGPLHKCDISSSTEAGQKLLNMLRLGKSEPWTLALENVVGAKNMDVRPLLNYFEPLFTWLKDQNKNSFVGWSTNWSPYTDQRIKVRISLKSALGDQAYEWNDNEMYLFRSSVAYAMREYFLKAKNQMIPFGEEDVRVADLKPRISFNFFVTAPQNVSDIIPRIEVEEAIRMSRSRINDAFRLNDNSLEFLGIQPTLGPPYQPPVTIWLIVFGVVMGMVVVGIVILIITGIRDRKKKNEARSEENPYASIDIGKGEDNPGFQNSDEVQTSF

SEQ ID NO: 89 - protein, 805 aa, Sapajus apella
MSGSFWLLLSLVAVTAAQSTVEEQAKTFLDKFNHEAEDLFHENSLASWNYNTNITEENVQNMNVAGEKWSAFFKEQSKLAQTYPLKEIQNLTVKLQLQALQQNGSSVLSEDKSKRLNTIINTMSTIYSTGKVCNPNYPQECLLLEPGLNEIMAKSTDYNERLWAWEGWRSEVGKQLRPLYEEYVVLKNEMARANHYEDYGDYWRGDYEVNGVDGYDYYRNQLIEDVERTFEEIKPLYEHLHAYVRAKLMNVYPSYISPTGCLPAHLLGDMWGRFWTNLYSLTVPFGQKPNIDVTDEMVKQAWDAQRIFKEAEKFFASVGLPNMTQGFWENSMLTEPGDGQKVVCHPTAWDLGKQDFRILMCTKTTMDDFLTAHHEMGHIQYDMAYAAQPFLLRNGANEGFHEAVGEIMSLSAATPKHLKSIGLLSPDFQEDSETEINFLLKQALTIVGTLPFTYMLEKWRWMVFKGEIPKEQWMKKWWDMKREIVGVVEPVPHDETYCDPASLFHVSNDYSFIRYYTRTLYQFQFQEALCQAAKHEGPLHKCDISSSTEAGQKLLNMLRLGKSEPWTLALENVVGAKNMDVRPLLNYFEPLFTWLKDQNKNSFVGWSTNWSPYTDQRIKVRISLKSALGDQAYEWNDNEMYLFRSSVAYAMREYFLKAKNQMIPFGEEDVRVADLKPRISFNFFVTAPQNVSDIIPRIEVEEAIRMSRSRINDAFRLNDNSLEFLGIQPTLGPPYQPPVTIWLIVFGVVMGMVVVGIVILIITGIRDRKKKNEARSEENPYASIDIGKGEDNPGFQNSDEVQTSF

SEQ ID NO: 90 - protein, 805 aa, Carlito syrichta
MSGSSWLILSLVVVTAAQSTPEEQVKTFLDKFNQEAEDLYHQSSLAAWNYNTNITEENSQQMNDAGEIWSAFYNEQSKIAQSYPIQEIQNSTIKRQLQALQYNGSSVLSEDKRKRLNTILSTMSTIYSTGKVCNPNNPQDCLVLTPGLDDIMAQSTDYSKRLWVWEGWRSEIGKQLRPLYEEYVDLKNEMARANGYEDYGDYWRGDYAAEGVDGYDYNSTQLIEDVEHTFEQIKPLYEQLHAYVRGKLMNAYPSRISPTGCLPAHLLGDMWGRFWTNLYSLTVPFEQKPNIDVTETMVNQAWDAQKIFREAEKFFTSVGLPNMTQEFWVNSVLTEPKDGRKVSCHPTAWDLGNSDFRILMCTKVTMDYFLTAHHEMGHIQYDMAYATQPFLLRNGANEGFHEAVGEIMSLSAATPKHLKSIGLLPLDFQEDNETEINFLLKQALTIVGTLPFTYMLEKWRWMVFKGEIPKEQWMQKWWEMKREIVGVVEPLPHDETYCDPASLFHVSNDYSFIRYYTRTIYQFQFQEALCQAAKHEGPLHKCDISNSVEAGQKLFQMLRLGKSEPWTLALKNIVGEKNMNVRPLLSYFEPLLTWLKDQNKNSFVGWTTDWSPYADESIKVRISLKSALGENAYTWNDNEMYFFQSSVAYAMRKYFLVVKNQMMPFGVENVWISDLKPRVSFNFFVTSPKNLNDIIPRTEVEEAIRMSRGRINNAFHLDDNTLEFLGIQPTLAPPSQPPITIWLIVFGVVMGVVVVGIFVLIFTGIRDRKKKNQARSEENPYASVDSGKGENNPGFQSSDDGQTSF

SEQ ID NO: 91 - protein, 805 aa, Otolemur garnettii
MSSSFWLLLSLVAVTAAQSTTEEQAKTFLDNFNREVEELSHQAALASWDYNTNITEENAQKMNDAEAKRSAFYEEQSKISQTYPLEEIQNRTVKRQLKALQQRGSSALPADKNKRLSTILNTMSTIYSTGKVCNSNNPQECLLLEPGLEAIMANSRDYNERLWAWEGWRAEVGKQLRPLYEEYVDLKNEMARANNYEDYGDYWRADYDAEGEDGYGYNRSQLIEDVEHIFTQVKPLYEQLHAYVRTKLMNAYPSRVSPTGCLPAHLLGDMWGRFWTNLYSLAVPFEQKPNIDVTDAMVNQGWDAQRIFKEAEDFFVTVSLPEMTQGFWQNSMLVEPEDGRRVVCHPTAWDLGKDDFRIKMCTKVTMDDFLTAHHEMGHIQYDMAYAKQPFLLRSGANEGFHEAVGEIMSLSVATPKHLQSIGLLPRDFQEDNETEINFLLKQALTIVGTLPFTYMLEKWRWMVFKGEIPKDQWMKKWWEMKREIVGVVEPLPHDETYCDPASLFHVSNDYSFIRYYTRTIYQFQFQEALCQAAQHQGPLHKCDISRSTEAGQKLLNMMSLGKSEPWTLALENVVGARNMDVSPLLTYFEPLFTWLKEQNRNSFVGWDTNWSPYADQSIKVRISLKSGLGDKPYEWNDNEMYLFQSSVAYAMRQYFSECKQQTVPFGEEDVWVSDIKPRISFSFFVTAPKNVSEIIPRTEVEEAIRMSRSRINGVFRLDDNSLEFLGIQPTLSPPYQPPITIWLIVFGIVMALVVVGIVILIITGIRDRRRKNQARGEENPYAFVDLGKEENTAESPNGDDIQTSF

SEQ ID NO: 92 - protein, 851 aa, Microcebus murinus
MRENLMRRFYSRERLFSGCDLGSPGKMSSSFWLLLSLISVTAAQSTTEEQAKTFLENFNNEAEDLSHQSALASWDYNTNITEENAQKMSDHGAKWSAFYEEQSKLAQTYPLEAIQNLTIKRQLRVLQQSGSSGLSADKNKQLNTILNTMSTIYSTGKVCNPNNPQDCLLLEPGLDTIMANSRDYSQRLWAWEGWRSEVGKQLRPLYEEYVVLKNEMARANNYEDYGDYWRADYEAEGESGYNYNRSQLMEDVEHTFAQIKPLYEHLHAYVRAKLMNVYPSHINPNGCLPAHLLGDMWGRFWTNLYSLTVPFEQKPNIDVTDAMVNQAWDANRILKEAENFFVSVGLPNMTQGFWEKSMLTEPEDGRKVICHPTAWDLGKGDFRIKMCTKVTMDNFLTAHHEMGHIQYDMAYAIQPFLLRNGANEGFHEAVGEIMSLSAATPKHLKSIGLLPPDFQEDDETEINFLLKQALTIVGTLPFTYMLEKWRWMVFKGEIPKDQWMKKWWEMKREIVGVVEPVPHDETYCDPASLFHVSNDYSFIRYYTRTIYQFQFQEALCRAAKHEGPLHRCDISNSTEAGQKLLNMLRLGKSEPWTLALENVVGARNMNVTPLLNYFEPLFTWLKDQNRNSFVGWNTNWSPYADESIKVRISLKSALGTNAVSVFSLFFQLTIFFTCRPNKHNGMTKELYLFPVICGICMRKVFLEAKSQTVPFGVEDVWVNDFKPRISFTFFVTAPKNVSDIIPRTEVEKAISMSRSRINDVFGLDDNTLEFLGIQPTLSPPYESPISIWLIAFGIVMGLVVVATVVLIFTGIRNRKKKSEERSEENPYASMDINRGEHNPGFQNSDDTQTSF

SEQ ID NO: 93 - protein, 826 aa, Propithecus coquereli
MRRFYSRERLFSGCDLGSPGKMSSSFWLLLSLISVTAAQSTTEEQAKTFLDKFNHEAEDLSYQSALASWDYNTNITEENAQKMNDYGDKLSAFYEEQSKLAQTYPLEEIQNVTVKRQLQALQQSGSSGLSADKSKQLNTILSTMSTMYSTGTVCNPNNPQECLLLEPGLDTIMANSRDYSERLWAWEGWRSEVGKQLRPLYEEYVVLKNEMARANNYEDYGDYWRADYEAEGENGYNYNRSQLIEDVESTFAQIKPLYEHLHAYVRAKLMNAYPSHISPTGCLPAHLLGDMWGRFWTNLYSLTVPFEQKPNIDVTDAMVNQAWDAKRIFKEAENFFVSVGLPNMTQGFWENSMLTEPEDGRKVICHPTAWDLGKGDFRIKMCTKVTMDDFLTAHHEMGHIQYDMAYAIQPFLLRDGANEGFHEAVGEIMSLSAATPKHLKSIGLLPPDFEEDNETEINFLLKQALTIVGTLPFTYMLEKWRWMVFKGEIPKDQWMKKWWEMKREIVGVVEPLPHDETYCDPASLFHVSNDYSFIRYYTRTIYQFQFQEALCQVAKHEGPLHRCDISNSTEAGQKLLNMLSLGKSEPWTLALENVVGARNMDVTPLLNYFEPLFTWLKDQNRNSFVGWNTNWSPYADQSIKVRISLKSALGDKAYEWNDNEMFLFRSSVAYAMREYFLKVKNQTVLFGVEDVWVNDLKPRISFTFFVTAPNNVSDIIPRAEVEEAIRKSRSRINDAFGLDDNTLEFLGIQPTLSAPYQSSVATWLIAFGVVMGLVVVATVVLIFTGIRNRKKKNQERSEENPYAFVDVNRGEHNPGFQNSDDIQTSF

SEQ ID NO: 94 - protein, 809 aa, Vombatus ursinus
MSGSEKSKMTLSLVAVTAAQFSTEERAKEFLETFNKEAEEISYQSSLASWDYNTNINDENVQKMNEAAARWSAFYKSQSNISRTFPLNEISDPQIKLQLKSLQEKGAAVLSAEKSARLNTVLNTMSTLYSTATICNPKTTQECLLLEPGLDKIMEESKDYYERLWAWEGWRSKVGKEMRPLYEEYVELKNEVAKGNDYEDYGDYWRADYEIEGSSESHYSRSQLIEDVEQIFLQIKPLYEHLHAYVRRRMMATYGPLISETGGLPAHLLGDMWGRFWTNLYSLTVPYSGKPNIDVTQAMKDQNWNAQRIFEEAENFFVSVGLYNMTEGFWKNSMLTEPNDGRKVVCHPTAWDLGKGDFRIKMCTKVTMDDFLTAHHEMGHIQYDMAYASQPYLLRNGANEGFHEAVGEIMSLSAATPTHLKALGLLPPTFQEDSDTDINFLFKQALTIVGTMPFTYMLEKWRWLVFKGEIPKEEWMKKWWEMKRDIVGVVEPLPHDETYCDPATLFHVANDYSFIRYYTRTVYQFQFHEALCRIAQPSAALHKCDITNSTAAGTKLLDMLKLGKSEPWTVALENMVGNKRMNATPLLEYFEPLFTWLKEQNKNAYVGWNTDWSPYNEYSIKVRISLKSALGENAYDWNENEMYLFQAVIAFAMRQYFFQKKKETIPFRDENVKVFDLKPRISFYFFVTAPPNGSHVPREDVEEAIRHSRGRINDAFRLNDNSLEFVGIPTTLAPPSEPPVTAWLIAFGVVMGMVMIGILFLIYTGIRDRKKRNKSQEAKRAENPYAEVHSIGGQHNAGFQNTEDVQTSF

SEQ ID NO: 95 - protein, 804 aa, Desmodus rotundus
MSGSSWLFLSLVAVAAAQTPTEEEARTFLENFNTEAEEWFYQNSLASWNYNTNITDENVQKMNEAEQMWSTFYERNSNIAKTYPLETIKDVNVKRQLQALQQNGLLEDKDKQLQLNAILNTMSTIYSTGKVCKPNNPQECYLLATGLEDIMQDSKDYNERLWAWEGWRSKVGKQLRPLYEEYVVLKNEMAREKNYEDYGDYWRGDYETEGSSGYEYSRNQLIEDVENTFAEIKPLYEHLHAYVRAKLMDTYPSHISPTGCLPAHLLGDMWGRFWTNLYNLTAPFGEKPTIDVTAAMVDQSWDAQRIFKEAEKFFKSVGLFSMTQGFWDNSMLTKPDDGREVVCHPTAWDLGNKDFRIKMCTKVTMDDFLTAHHEMGHIQYDMAYANQSFLLRNGANEGFHEAVGEIMSLSVATPKHLKVLGLLPPDFHEDNETDINFLLKQALNIVGTLPFTYMLEKWRWMVFKGEIPKEQWMKKWWEMKREIVGVVEPVPHDETYCDPATLFHVANDYSFIRYYTRTIFQFQFQEALCQTAQHEGPLHKCDISNSTAAGEKLLQMLKLGKSEPWTRALENIVGKKQMDVRPLLNYFEPLFTWLKEQNRNSFVGWLTDWSPYAAESIKVRISLKSALGDKAYEWNDNEMYFFRSSIAYAMREYFSNFKNQTIPFRAEDVWVSDLKPRVSFNFFVTSPNSVSDIIPRSEVEEAIRKSRSRINDAFRLDDNSLEFLGIQPTLEPPYQPAVTIWLIAFGVVMGLVVVGIGVLIFTGIRERKRKSQETSEENPYSSMNLSKGESNPGFQNGDDVQTSF

SEQ ID NO: 96 - protein, 805 aa, Mus musculus
MSSSSWLLLSLVAVTTAQSLTEENAKTFLNNFNQEAEDLSYQSSLASWNYNTNITEENAQKMSEAAAKWSAFYEEQSKTAQSFSLQEIQTPIIKRQLQALQQSGSSALSADKNKQLNTILNTMSTIYSTGKVCNPKNPQECLLLEPGLDEIMATSTDYNSRLWAWEGWRAEVGKQLRPLYEEYVVLKNEMARANNYNDYGDYWRGDYEAEGADGYNYNRNQLIEDVERTFAEIKPLYEHLHAYVRRKLMDTYPSYISPTGCLPAHLLGDMWGRFWTNLYPLTVPFAQKPNIDVTDAMMNQGWDAERIFQEAEKFFVSVGLPHMTQGFWANSMLTEPADGRKVVCHPTAWDLGHGDFRIKMCTKVTMDNFLTAHHEMGHIQYDMAYARQPFLLRNGANEGFHEAVGEIMSLSAATPKHLKSIGLLPSDFQEDSETEINFLLKQALTIVGTLPFTYMLEKWRWMVFRGEIPKEQWMKKWWEMKREIVGVVEPLPHDETYCDPASLFHVSNDYSFIRYYTRTIYQFQFQEALCQAAKYNGSLHKCDISNSTEAGQKLLKMLSLGNSEPWTKALENVVGARNMDVKPLLNYFQPLFDWLKEQNRNSFVGWNTEWSPYADQSIKVRISLKSALGANAYEWTNNEMFLFRSSVAYAMRKYFSIIKNQTVPFLEEDVRVSDLKPRVSFYFFVTSPQNVSDVIPRSEVEDAIRMSRGRINDVFGLNDNSLEFLGIHPTLEPPYQPPVTIWLIIFGVVMALVVVGIIILIVTGIKGRKKKNETKREENPYDSMDIGKGESNAGFQNSDDAQTSF

SEQ ID NO: 97 - protein, 805 aa, Rattus norvegicus
MSSSCWLLLSLVAVATAQSLIEEKAESFLNKFNQEAEDLSYQSSLASWNYNTNITEENAQKMNEAAAKWSAFYEEQSKIAQNFSLQEIQNATIKRQLKALQQSGSSALSPDKNKQLNTILNTMSTIYSTGKVCNSMNPQECFLLEPGLDEIMATSTDYNRRLWAWEGWRAEVGKQLRPLYEEYVVLKNEMARANNYEDYGDYWRGDYEAEGVEGYNYNRNQLIEDVENTFKEIKPLYEQLHAYVRTKLMEVYPSYISPTGCLPAHLLGDMWGRFWTNLYPLTTPFLQKPNIDVTDAMVNQSWDAERIFKEAEKFFVSVGLPQMTPGFWTNSMLTEPGDDRKVVCHPTAWDLGHGDFRIKMCTKVTMDNFLTAHHEMGHIQYDMAYAKQPFLLRNGANEGFHEAVGEIMSLSAATPKHLKSIGLLPSNFQEDNETEINFLLKQALTIVGTLPFTYMLEKWRWMVFQDKIPREQWTKKWWEMKREIVGVVEPLPHDETYCDPASLFHVSNDYSFIRYYTRTIYQFQFQEALCQAAKHDGPLHKCDISNSTEAGQKLLNMLSLGNSGPWTLALENVVGSRNMDVKPLLNYFQPLFVWLKEQNRNSTVGWSTDWSPYADQSIKVRISLKSALGKNAYEWTDNEMYLFRSSVAYAMREYFSREKNQTVPFGEADVWVSDLKPRVSFNFFVTSPKNVSDIIPRSEVEEAIRMSRGRINDIFGLNDNSLEFLGIYPTLKPPYEPPVTIWLIIFGVVMGTVVVGIVILIVTGIKGRKKKNETKREENPYDSMDIGKGESNAGFQNSDDAQTSF

SEQ ID NO: 98 - protein, 799 aa, Eptesicus fuscus
MSGSSWLFLSLVAVTAAQSTTEKNATIFLENFNSEAEDLSHESALASWNYNTNITDENAQKMNEADSKWSAFYEKQSKLAQTYPLQEIQNLTIKLQLQVLQQNGSSVLTADKSKRLSTILTTMSTIYSTGKVCNPNNPQECLTLSGLEDIMEKSKDYNQRLWVWEGWRSEVGKQLRPLYEEYVVLKNEMARGNNYEDYGDYWRGDYETEGENGYNYSRSQLTEDVDRIFLEIKPLYEHLHAYVRAKLMDTYPSRISPTGCLPAHLLGDMWGRFWTNLYNLTVPFEQKPNIDVTDAMKEQSWDAEKIFKEAEKFYMSVGLPSMTPGFWNNSMLTEPGDGRKVVCHPTAWDLGKNDFRIKMCTKVTMDDFLTAHHEMGHIQYDMAYATQPYLLRNGANEGFHEAVGEVMSLSVATPKHLKGMGLLPSDFSEDNETEINFLLKQALNIVGTLPFTYMLEKWRWMVFKGEIPKEQWMKKWWEMKREIVGVVEPLPHDETYCDPASLFHVANDYSFIRYFTRTIFEFQFQEALCQIAKHQGPLHKCDISNSTEAGNKLLEMLKLGKSKPWTFALEKITGTKKMDAKPLLNYFEPLFTWLKEQNGNSVGWHSDADQSIKVRISLKSALGEKAYEWNDNEMYLFRSSVAYAMREYFLKVKNQTIPFRAEDVWVNDVKPRVSFKFFVTSPTNMSDIIPRSEVEDAIRMSRSRINAAFRLDDNSLEFLGIQPTLGPPYQPPVTIWLIVFGVVMGVVVIGIGVLIFTGIRDRKKKNQPGNEENPYSSVNLSKGENNPGFQSGDDVQTSF

SEQ ID NO: 99 - protein, 819 aa, Myotis lucifugus
MSGSSWLFLSLVAVAAAQSSTEEKAKIFLENFNSKAEDLSHESALASWNYNTNITDENVQKMNEADSKWSAFYEQQSKLAQTYPLQEIQNSTIKRQLQVLQQNGSSVLSADKSKRLNTILTTMSTIYSTGKVCNPNNPQECFTLAGLEEIMEKSKDYNQRLWVWEGWRSEVGKQLRPLYEEYVDLKNEMARGNNYEDYGDYWRGDYETEGEDGYNYSRNQLTEDVERIFLEIKPLYEHLHAYVRAKLVNAYPSRISPTGYLPAHLLGDMWGRFWTNLYNLTVPFEQKPNIDVTGAMVEQSWDAEKIFKEAEKFYISVGLPSMTPGFWNNSMLTEPGDGRKVVCHPTAWDLGKGDFRIKMCTKVTMDDFLTAHHEMGHIQYDMAYATQPYLLRNGANEGFHEAVGEVMSLSVATPKHLKGMGLLPPDFSEDNETEINFLLKQALNIVGTLPFTYMLEKWRWMVFKGEIPKEQWMKKWWEMKRDIVGVMEPLPHDETYCDPASLFHVANDYSFIRYFTRTIFEFQFQEALCQIAKHQGPLHKCDISNSKEAGNKLLEMLKLGKSEPWTLALDKIVGTKKMDAKPLLNYFEPLFTWLKEQNGNSVGWNSGNSVESRSGNSVGWFSDWSPYAEQSIKVRISLQSALGEKAYKWNDNEMYLFQSSVAYAMREYFLKEKNQTIPFGVENVRVNDIKPRVSFKFYVTSPKNMSVVIPRSEVEDAIRMSRSRINDAFRLDDNTLEFLGIQPTLGPPNQPPVTIWLIVFGVVMGVAVIGIAVLIFTGIRDRKKKKQAGNEENPYSSVNLSKGENNPGFQNGDDVQTSF

SEQ ID NO: 100 - protein, 805 aa, Pteropus alecto
MSGSFWLLLSLVAVTAAQSTPEELAKTFLEKFNTEVEDLFYQSSLASWDYNTNITDENVQKMNEARAKWSAFYEEQSKLAKAYQLDEIQDPILKLQLRILQQSGSSVLSADKTKRLNTILNTMSIIYSTGKVCKPDNPQECLLLEPGLDDIMESSKDYDQRLWAWEGWRSEVGKQLRPFYEEYVVLKNEMARGENYEDYGDYWRGDYETEGINGSAYNRDQLIEDVDRTFAEIKPLYEQLHAYVRAKLMDVYPSHISPTGCLPAHLLGDMWGRFWINLYQLTVPFEQKPNIDVTDEMVNQNWDEKRIFKEAEKFFVSLGLPNMTEKFWEKSMLTEPGNDQKVACHPTAWDLGKGDFRIIMCTKVKMEDFLTAHHEMGHIQYDMAYATQPYLLKNGANEGFHEAVGEVISLSVATPNHLKNMGLLPPDFYEDNETEINFLLKQALNVIGTLPFTYMLEKWRWMVFKGEIPKEQWMKKWWEMKRELVGVVEPLPHDETYCDPASLFHVANDYSFIRYYTRTIFEFQFQEALCRIAQHEGPLYKCDISNSTEAGKKLHEMLSFGKSKPWTLALESIVGTKNMDVRPLLNYFEPLFTWLKDQNRNSFVGWRTDWSPYADQSIKVRISLKSALGENAYEWNDNEMYLFKSSVAFAMREYFLKVKNLTIPFGEDDVWVSDLKPRISFNFFVTSPNNVSDIIPRTEVEEGIRMSRGRINDAFRLDDNSLEFLGIEPTLGTPYQPPVTIWLIVFGVVMGLVVVGIVLLIFAGIRDRRKKNQERSEENPYSSVDLSKGENNPGFQNNDDVQTSF

SEQ ID NO: 101 - protein, 804 aa, Pteropus vampyrus
MSGSFWLLLSLVAVTAAQSTPEELAKTFLEKFNTEVEDLFYQSSLASWDYNTNITDENVQKMNEARAKWSAFYEEQSKLAKAYQLDEIQDPILKLQLRILQQSGSSVLSADKTKRLNTILNTMSIIYSTGKVCKPDNPQECLLLEPGLDDIMESSKDYDQRLWAWEGWRSEVGKQLRPFYEEYVVLKNEMARGENYEDYGDYWRGDYETEGTNGSAYNPSLGLKLSSWAFQIKPLYEQLHAYVRAKLMDAYPSHISPTGCLPAHLLGDMWGRFWINLYQLTVPFEQKPNIDVTDEMVNQNWDEKRIFKEAEKFFVSLGLPNMTEKFWEKSMLTEPGNDQKVACHPTAWDLGKGDFRIIMCTKVKMEDFLTAHHEMGHIQYDMAYATQPYLLKNGANEGFHEAVGEVISLSVATPNHLKNMGLLPPDFYEDNETEINFLLKQALNVIGTLPFTYMLEKWRWMVFKGEIPKEQWMKKWWEMKRELVGVVEPLPHDETYCDPASLFHVANDYSFIRYYTRTIFEFQFQEALCRIAQHEGPLYKCDISNSTEAGKKLHEMLSFGKSKPWTLALESIVGTKNMDVRPLLNYFEPLFTWLKDQNRNSFVGWRTDWSPYADQSIKVRISLKSALGDNAYEWNDNEMYLFKSSIAYAMREYFLKVKNLTIPFGEDDVWVSDLKPRISFNFFVTSPNNVSDFIPRTEVEEAIRMSRGRINDAFRLDDNSLEFLGIEPTLEPPYQPPVTIWLIVFGVVMGLVVVGIVLLIFAGIRDRRKKNQERSEENPYSSVDLSKGENNPGFQNNDDVQTSF

SEQ ID NO: 102 - protein, 805 aa, Oryctolagus cuniculus
MSGSSWLLLSLVAVTAAQSTIEELAKTFLEKFNQEAEDLSYQSALASWDYNTNITEENVQKMNDAEAKWSAFYEEQSKLAKTYPSQEVQNLTVKRQLQALQQSGSSALSADKSKQLNTILSTMSTIYSTGKVCNQSNPQECFLLEPGLDEIMAKSTDYNERLWAWEGWRSVVGKQLRPLYEEYVVLKNEMARANNYEDYGDYWRADYEAEGADGYDYSRSQLIDDVERTFSEIKPLYEQLHAFVRTKLMDAYPSRISPTGCLPAHLLGDMWGRFWTNLYSLTVPFGQKPNIDVTDTMVNQGWDAERIFKEAEKFFVSVGLPSMTQGFWENSMLTEPGDGRKVVCHPTAWDLGKGDFRIKMCTKVTMDNFLTAHHEMGHIQYDMAYATQPFLLRNGANEGFHEAVGEIMSLSAATPEHLKSIGLLPYDFHEDNETEINFLLKQALTIVGTLPFTYMLEKWRWMVFKGEIPKEQWMQKWWEMKREIVGVVEPMPHDETYCDPAALFHVANDYSFIRYYTRTIYQFQFQEALCQAAQHEGPLHKCDISNSTEAGQKLLNMLRLGRSEPWTLALENVVGAKNMDVRPLLNYFEPLFTWLKEQNRNSFVGWSTEWTPYADQSIKVRISLKTALGDQAYEWNDSEMYLFRSSVAYAMRKYFSEVKNQTILFGEEDVRVSDLKPRISFNFFVTAPNNVNDIIPRNEVEEAISMSRSRINDIFRLDDNSLEFVGIQPTLEPPYESPVPIWLVVFGVVMGMIVIGIVVLIFTGIKDRRKQKQAKREENPYGFVDMSKGENNSGFQNSDDIQTSF

SEQ ID NO: 103 - protein, 805 aa, Sus scrofa
MSGSFWLLLSLIPVTAAQSTTEELAKTFLEKFNLEAEDLAYQSSLASWTINTNITDENIQKMNDARAKWSAFYEEQSRIAKTYPLDEIQTLILKRQLQALQQSGTSGLSADKSKRLNTILNTMSTIYSSGKVLDPNNPQECLVLEPGLDEIMENSKDYSRRLWAWESWRAEVGKQLRPLYEEYVVLENEMARANNYEDYGDYWRGDYEVTGTGDYDYSRNQLMEDVERTFAEIKPLYEHLHAYVRAKLMDAYPSRISPTGCLPAHLLGDMWGRFWTNLYPLTVPFGEKPSIDVTEAMVNQSWDAIRIFEEAEKFFVSIGLPNMTQGFWNNSMLTEPGDGRKVVCHPTAWDLGKGDFRIKMCTKVTMDDFLTAHHEMGHIQYDMAYAIQPYLLRNGANEGFHEAVGEIMSLSAATPHYLKALGLLPPDFYEDSETEINFLLKQALTIVGTLPFTYMLEKWRWMVFKGEIPKEQWMQKWWEMKREIVGVVEPLPHDETYCDPACLFHVAEDYSFIRYYTRTIYQFQFHEALCRTAKHEGPLYKCDISNSTEAGQKLLQMLSLGKSEPWTLALENIVGVKTMDVKPLLSYFEPLLTWLKAQNGNSSVGWNTDWTPYADQSIKVRISLKSALGEDAYEWNDNEMYLFRSSIAYAMRNYFSSAKNETIPFGAVDVWVSDLKPRISFNFFVTSPANMSDIIPRSDVEKAISMSRSRINDAFRLDDNTLEFLGIQPTLGPPDEPPVTVWLIIFGVVMGLVVVGIVVLIFTGIRDRRKKKQASSEENPYGSMDLSKGESNSGFQNGDDIQTSF

SEQ ID NO: 104 - protein, 811 aa, Bos taurus
MTGSFWLLLSLVAVTAAQSTTEEQAKTFLEKFNHEAEDLSYQSSLASWNYNTNITDENVQKMNEARAKWSAFYEEQSRMAKTYSLEEIQNLTLKRQLKALQHSGTSALSAEKSKRLNTILNKMSTIYSTGKVLDPNTQECLALEPGLDDIMENSRDYNRRLWAWEGWRAEVGKQLRPLYEEYVVLENEMARANNYEDYGDYWRGDYEVTGAGDYDYSRDQLMKDVERTFAEIKPLYEQLHAYVRAKLMHTYPSYISPTGCLPAHLLGDMWGRFWTNLYSLTVPFEHKPSIDVTEKMENQSWDAERIFKEAEKFFVSISLPYMTQGFWDNSMLTEPGDGRKVVCHPTAWDLGKGDFRIKMCTKVTMDDFLTAHHEMGHIQYDMAYAAQPYLLRNGANEGFHEAVGEIMSLSAATPHYLKALGLLAPDFHEDNETEINFLLKQALTIVGTLPFTYMLEKWRWMVFKGEIPKQQWMEKWWEMKREIVGVVEPLPHDETYCDPACLFHVAEDYSFIRYYTRTIYQFQFHEALCKTAKHEGALFKCDISNSTEAGQRLLQMLRLGKSEPWTLALENIVGIKTMDVKPLLNYFEPLFTWLKEQNRNSFVGWSTEWTPYSDQSIKVRISLKSALGENAYEWNDNEMYLFQSSVAYAMRKYFSEARNETVLFGEDNVWVSDKKPRISFKFFVTSPNNVSDIIPRTEVENAIRLSRDRINDVFQLDDNSLEFLGIQPTLGPPYEPPVTIWLIIFGVVMGVVVIGIVVLIFTGIRNRRKHDNDGLQNDENLRVQQQAVKVDISRNSLKAPVPFSNSHEKLK

SEQ ID NO: 105 - protein, 804 aa, Ovis aries
MTGSFWLLLSLVAVTAAQSTTEGQAKTFLEKFNHEAEDLSYQSSLASWNYNTNITDENVQKMNEARAKWSAFYEEQSRMARTYSLEEIQNLTLKRQLKALQHSGTSVLSAEKSKRLNTILNKMSTIYSTGKVLDPNTQECLALEPGLDDIMENSRDYNRRLWAWEGWRAEVGKQLRPLYEEYVVLENEMARANNYEDYGDYWRGDYEVTGAGDYDYSRDQLMKDVERTFEEIKPLYEQLHAYVRAKLMDTYPSYISPTGCLPAHLLGDMWGRFWTNLYSLTVPFEHKPSIDVTEKMKNQSWDAERIFKEAEKFFVSIGLPYMTQGFWDNSMLTEPGDGRKVVCHPTAWDLGKGDFRIKMCTKVTMDDFLTAHHEMGHIQYDMAYATQPYLLRNGANEGFHEAVGEIMSLSAATPHYLKALGLLAPDFYEDNETEINFLLKQALTIVGTLPFTYMLEKWRWMVFKGEIPKQQWMEKWWEMKREIVGVVEPLPHDETYCDPACLFHVAEDYSFIRYYTRTIYQFQFHEALCKTAKHEGALFKCDISNSTEAGQRLLQMLRLGKSEPWTLALENIVGIKTMDVKPLLNYFEPLFTWLKEQNRNSFVGWSTEWTPYSDQSIKVRISLKSALGENAYEWNDNEMYLFRSSVAYAMRKYFLKERNETIPFGEENVWVSDKKPRISFKFFVTSPNNVSDIIPRTEVENAIRLCRDRINDAFQLDDNSLEFLGIQPTLRPPYEPPVTIWLIIFGVVMGVVVIGIVVLIFTGIRDQRKKNQASSEENPYGSVDLNKGENNSGFQNTDDVQTSL

SEQ ID NO: 106 - protein, 804 aa, Bos mutus
MTGSFWLLLSLVAVTAAQSTTEEQAKTFLEKFNHEAEDLSYQSSLASWNYNTNITDENVQKMNEARAKWSAFYEEQSRMAKTYSLEEIQNLTLKRQLKALQHSGTSALSAEKSKRLNTILNKMSTIYSTGKVLDPNTQECLALEPGLDDIMENSRDYNRRLWAWEGWRAEVGKQLRPLYEEYVVLENEMARANNYEDYGDYWRGDYEVTGAGDYDYSRDQLMKDVERTFAEIKPLYEQLHAYVRAKLMHTYPSYISPTGCLPAHLLGDMWGRFWTNLYSLTVPFEHKPSIDVTEKMENQSWDAERIFKEAEKFFVSISLPYMTQGFWDNSMLTEPGDGRKVVCHPTAWDLGKGDFRIKMCTKVTMDDFLTAHHEMGHIQYDMAYAAQPYLLRNGANEGFHEAVGEIMSLSAATPHYLKALGLLAPDFHEDNETEINFLLKQALTIVGTLPFTYMLEKWRWMVFKGEIPKQQWMEKWWEMKREIVGVVEPLPHDETYCDPACLFHVAEDYSFIRYYTRTIYQFQFHEALCKTAKHEGALFKCDISNSTEAGQRLLQMLRLGKSEPWTLALENIVGIKTMDVKPLLNYFEPLFTWLKEQNRNSFVGWSTEWTPYSDQSIKVRISLKSALGENAYEWNDNEMYLFQSSVAYAMRKYFSEARNETVLFGEDNVWVSDKKPRISFKFFVTSPNNVSDIIPRTEVENAIRLSRDRINDVFQLDDNSLEFLGIQPTLGPPYEPPVTIWLIIFGVVMGVVVIGIVVLIFTGIRDRRKKNQASSEENPYGSVDLNKGENNSGFQNTDDVQTSL

SEQ ID NO: 107 - protein, 804 aa, Physeter catodon
MSGSFWLLLSLVAVTAAQSTTEEQAKTFLQKFDHEAEDLSYQSSLASWNYNTNITDENVQKMNAARAKWSAFYEEQSRTAKTYPLEEIQNLTLKRQLQALQQSGTSVLSADKSKRLNTILNTMSTIYSSGKVLDPNTQECLVLEPGLDDIMENSEDYSRRLWAWEAWRAEVGKQLRPLYEEYVVLENEMARANNYEDYGDYWRGDYEVTGAGDYDYSRDQLITDVERTFAEIKPLYEQLHAYVRAKLMDAYPSRISPTGCLPAHLLGDMWGRFWTNLYPLTVPFGEKSSIDVTKEMRNQSWDAKRIFKEAEKFFVSIGLPNMTQEFWDNSMLTEPGDGRKVVCHPTAWDLGKGDFRIKMCTKVTMDDFLTARHEMGHIQYDMAYATQPYLLRNGANEGFHEAVGEIMSLSAATPHYLKALGLLPPDFYEDSATEINFLLKQALKIVGTLPFTYMLEKWRWMVFKGEIPKEQWMQKWWEMKREIVGVVEPLPHDETYCDPACLFHVAEDYSFIRYYTRTIYQFQFHEALCQAAKHEGPLYKCDISNSTEAGQRLLQMLHLGKSEPWTSALENIVGVKTMDVKPLLNYFEPLLTWLKDQNRNSFVGWSTDWTPYSDQSIKVRISLKSALGEKAYEWNDNEMYLFRSSVAYAMREYFSKVRNETIPFGEEDVRVGDLKPRISFTFFVTSPKNVSDIIPRTEVEEAIRMSRGRINDAFRLDDNSLEFLGIEPTLGPPYEPPVTIWLIIFGVVMGVVVIGIAVLSFTGIRDRRKKNRASTEENPYGSVDLSKGENNSGFQNSDDVQTSF

SEQ ID NO: 108 - protein, 804 aa, Monodon monoceros
MSGSFWLLLSLVAVTAAPSTTEEQAKTFLQKFDHEAEDLSYQSSLASWNYNTNITDENVQKMNAAGAKWSAFYEEQSKIAKTYPLAEIRNLTLKRQLQVLQQSGTSVLSADKSKRLNTILSTMSTIYSSGKVLDPNTQECLVLEPGLDDIMENSKDYNRRLWAWEGWRAEVGKQLRPFYEEYVVLENEMARANNYEDYGDYWRGNYEVTGAGDYDYSRDQLITDVERTFAEIKPLYEQLHAYVRAKLMDAYPSRISPTGCIPAHLLGDMWGRFWTNLYPLTVPFGERPSIDVTKEMQNQSWDAKRIFKEAEKFFVSIGLPNMTQEFWDNSMLTEPGDGRKVVCHPTAWDLGKGDFRIKMCTKVTMDGFLTAHHEMGHIQYDMAYATQPYLLRNGANEGFHEAVGEIMSLSAATPHYLKALGLLPPDFYEDRVTEINFLLKQALTIVGTLPFTYMLEKWRWMVFKGEIPKEQWMQKWWEMKREIVGVVEPLPHDETYCDPACLFHVAEDYSFIRYYTRTIYQFQFHEALCQTAKHEGPLYKCDISNSTEAGQRLLQMLRLGKSEPWTSALESIAGVKTMDVKPLLNYFEPLLTWLKDQNRNSFVGWNTDWTPYSDQSIKVRISLKSALGEKAYEWNDNEMYLFRSSVAYAMREYFSKVRNETIPFGGEDVRVSDLKPRISFNFFVTSPKNMSDIIPRTEVEEAIRMSRGRINDAFRLDDSSLEFLGVQPTLAPPYEPPVTVWLIIFGVVMGVVVIGIVVLIFTGIRDRRKKNQASSEENPYDSVGLSKGENNSGFQNSDDVQTSF

SEQ ID NO: 109 - protein, 804 aa, Orcinus orca
MSGSFWLLLSLVAVTAAQSATEERAKTFLQKFDREAEDLSYQSSLASWNYNTNITDENVQKMNAAGAKWSAFYEEQSRIAKTYPLEEIRNLTLKRQLQVLQQSGTSVLSADKSKRLNAILSTMSTIYSSGKVLDPNTQECLVLEPGLDDIMENSKDYSRRLWAWEGWRAEVGKQLRPLYEEYVVLENEMARANNYEDYGDYWRGDYEVTGAGDYDYSRDQLIRDVERTFAEIKPLYEQLHAFVRAKLMDAYPSRISPTGCLPAHLLGDMWGRFWTNLYPLTVPFGERPSIDVTKEMQNQSWDAKRIFKEAEKFFVSIGLPNMTQGFWDNSMLTEPGDGRKVVCHPTAWDLGKGDFRIKMCTKVTMDDFLTAHHEMGHIQYDMAYATQPYLFRNGANEGFHEAVGEIMSLSAATPHYLKALGLLPPDFYEDSATEINFLLKQALTIVGTLPFTYMLEKWRWMVFKGEIPKEQWMQKWWEMKREIVGVVEPLPHDETYCDPACLFHVAEDYSFIRYYTRTIYQFQFHEALCQTAKHEGPLYKCDISNSTEAGQRLLQMLHLGKSEPWTSALERIVGVKTMDVKPLLNYFEPLLTWLKEQNRNSFVGWRTDWTPYSNQSIKVRISLKSALGEKAYEWNDNEMYLFRSSVAYAMREYFSKVRNKTIPFGEKDVWVSDLKPRISFNFFVTSPKNMSDIIPRTEVEEAIRMSRGRINDAFRLDDSSLEFLGVQPTLAPPYEPPVTVWLIIFGVVMGVVVIGIVVLIFTGIRDRRKKNQASSEENPYGSVGLSKGENNPGFQNSDDVQTSF

SEQ ID NO: 110 - protein, 804 aa, Canis lupus familiaris
MSGSSWLLLSLAALTAAQSTEDLVKTFLEKFNYEAEELSYQSSLASWNYNINITDENVQKMNNAGAKWSAFYEEQSKLAKTYPLEEIQDSTVKRQLRALQHSGSSVLSADKNQRLNTILNSMSTVYSTGKACNPSNPQECLLLEPGLDDIMENSKDYNERLWAWEGWRSEVGKQLRPLYEEYVALKNEMARANNYEDYGDYWRGDYEEEWENGYNYSRNQLIDDVELTFTQIMPLYQHLHAYVRTKLMDTYPSYISPTGCLPAHLLGDMWGRFWTNLYPLTVPFGQKPNIDVTNAMVNQSWDARKIFKEAEKFFVSVGLPNMTQEFWGNSMLTEPSDSRKVVCHPTAWDLGKGDFRIKMCTKVTMDDFLTAHHEMGHIQYDMAYAAQPFLLRNGANEGFHEAVGEIMSLSAATPNHLKNIGLLPPSFFEDSETEINFLLKQALTIVGTLPFTYMLEKWRWMVFKGEIPKDQWMKTWWEMKRNIVGVVEPVPHDETYCDPASLFHVANDYSFIRYYTRTIYQFQFQEALCQIAKHEGPLHKCDISNSSEAGQKLLEMLKLGKSKPWTYALEIVVGAKNMDVRPLLNYFEPLFTWLKEQNRNSFVGWNTDWSPYADQSIKVRISLKSALGEKAYEWNNNEMYLFRSSIAYAMRQYFSEVKNQTIPFVEDNVWVSDLKPRISFNFSVTSPGNVSDIIPRTEVEEAIRMYRSRINDVFRLDDNSLEFLGIQPTPGPPYEPPVTIWLIVFGVVMGVVVVGIVLLIFSGIRNRRKNDQARGEENPYASVDLSKGENNPGFQSGDDVQTSF

SEQ ID NO: 111 - protein, 805 aa, Mustela putorius
MLGSSWLLLSLAALTAAQSTTEDLAKTFLEKFNYEAEELSYQNSLASWNYNTNITDENIQKMNIAGAKWSAFYEEESQHAKTYPLEEIQDPIIKRQLRALQQSGSSVLSADKRERLNTILNAMSTIYSTGKACNPNNPQECLLLEPGLDDIMENSKDYNERLWAWEGWRSEVGKQLRPLYEEYVALKNEMARANNYEDYGDYWRGDYEEEWADGYSYSRNQLIEDVEHTFTQIKPLYEHLHAYVRAKLMDAYPSRISPTGCLPAHLLGDMWGRFWTNLYPLMVPFRQKPNIDVTDAMVNQSWDARRIFEEAETFFVSVGLPNMTEGFWQNSMLTEPGDNRKVVCHPTAWDLGKRDFRIKMCTKVTMDDFLTAHHEMGHIQYDMAYAEQPFLLRNGANEGFHEAVGEIMSLSAATPNHLKNIGLLPPDFSEDSETDINFLLKQALTIVGTLPFTYMLEKWRWMVFKGEIPKEQWMQKWWEMKRDIVGVVEPLPHDETYCDPAALFHVANDYSFIRYYTRTIYQFQFQEALCQIAKHEGPLYKCDISNSSEAGQKLHEMLSLGRSKPWTFALERVVGAKTMDVRPLLNYFEPLFTWLKEQNRNSFVGWNTDWSPYADQSIKVRISLKSALGEKAYEWNDNEMYFFQSSIAYAMREYFSKVKNQTIPFVGKDVRVSDLKPRISFNFIVTSPENMSDIIPRADVEEAIRKSRGRINDAFRLDDNSLEFLGIQPTLEPPYQPPVTIWLIVFGVVMGVVVVGIFLLIFSGIRNRRKNNQARSEENPYASVDLSKGENNPGFQNVDDVQTSF

SEQ ID NO: 112 - protein, 805 aa, Ailuropoda melanoleuca
MLGSSWLLLSLAALTAAQSTTEDLAETFLEKFNYEAEDLYYQSSLASWNYNTNITDENIEKMNDAGAKWSAFYEEQSKHAKTYPLEEIHNSTVKRQLQALQHSGSSVLSADKSQRLNTILNAMSTIYSTGKACNPNNPQECLLLEPGLDDIMENSNDYNERLWAWEGWRSEVGKQLRPLYEEYVALKNEMARANNYEDYGDYWRGDYEEEWTDGYNYSRNQLIEDVEHTFTQIKPLYEHLHAYVRAKLMDTYPSRISPTGCLPAHLLGDMWGRFWTNLYPLTIPFGQKPNIDVTHAMVNQNWDARRIFEEAEKFFVSVGLPNMTQEFWENSMLTEPGDGQKVVCHPTAWDLGKGDFRIKMCTKVTMDDFLTAHHEMGHIQYDMAYAEQPFLLRNGANEGFHEAIGEIMSLSAATPNHLKNIGLLPPGFSEDNETEINFLLKQALTIVGTLPFTYMLEKWRWMVFQGKIPKEQWMKKWWEMKRDLVGVVEPLPHDETYCDPASLFHVANDYSFIRYYTRTIYQFQFQEALCQIAKHEGPLHKCDISNSSEAGKTLLQMLRLGRSKPWTLALERVVGAKNMDVRPLLNYFEPLFTWLKEQNRNSFVGWNTDWSPYADQSIKVRISLKSALGKEAYEWNDNEMYLFRSSIAYAMRKYFSEAKTQTIPFVEDNVWVSNLKPRISFNFFVTSPGNVSDVIPRADVEDAIKMSRDRINDAFRLDDNSLEFLGIQPTLGPPYQPPVTIWLIVFGVVMGLVVIGIILLIFSGIRNRRKNDQARSEENPYASVDLSKGENNPGFQNADDVQTSF

SEQ ID NO: 113 - protein, 806 aa, Zalophus californianus
MLGSSWLLLSLAALTAARSTTEDLVKTFLEKFNSEAEELSYQSSLASWNYNTNITDENVQKMNDAGAKWSAFYEEQSKQAKTYPLEEIQDSTVKRQLQALQHSGSSVLSADKSQRLNTILNAMSTIYSTGKACNPNNPQECLLLEPGLDDIMANSRDYNERLWAWEGWRSEVGKQLRPLYEEYVALKNEMARANNYEDYGDYWRGDYEEEWTNGYNYSRDQLIKDVEQTFTQIQPLYEHLHAYVRAKLMDTYPSHISPTGCLPAHLLGDMWGRFWTNLYPLTVPFGQKPNIDVTDTMVNQSWDARRIFEEAEKFFVSVGLPNMTQGFWDNSMLTEPGDSRKVVCHPTAWDLGKHDFRIKMCTKVTMDDFLTAHHEMGHIQYDMAYATQPFLLRNGANEGFHEAVGEIMSLSAATPKHLKTIGLLPPGFSEDNETDINFLFKQALTIVGTLPFTYMLEKWRWMVFKGEIPKEQWMKKWWEMKRDLVGVVEPLPHDETYCDPASLFHVANDYSFIRYYTRTIYQFQFQEALCQIAKHEGPLHKCDISNSSEAGQTLLQMLKLGRSKPWTLALYRVVGAKNMDVRPLLNYFDPLFTWLKEQNRNSFVGWNTDWSPYADQSIKVRISLKSALGEKAYEWNDNEMYLFRSSIAYAMREYFSKVKNQMIPFVEDNVWVNNLKPRISFTFFVTSPGNMSDIIPRADVEEAIRMSRGRINDAFRLDDNSLEFLGIQPTLEPPYQPPVTIWLIVFGVVMAVVVVGIVLLIFSGIRSRRKNDQATSEENPYASVNLSKGENNPGFQNVDDVQTSSF

SEQ ID NO: 114 - protein, 764 aa, Neomonachus schauinslandi
MLGSSWLLLSLAALTAAQSTTEDLVKTFLEKFNYEAEELSYQSSLASWNYNTNITDENIQKMNVAEAKWSAFYKNQSKQAKTYPLEEIQDSTLKRQLQTLQHSGSSVLSADKSERLSTILNAMGTIYSTGKACNPNNPQECLLLEPGLDDIMANSRDYNERLWAWEGWRSEVGKQLRPLYEEYVALKNEMARANNYEDYGDYWRGDYEEEWPNGYNYSHDQLIKDVEQTFTQIQPLYEHLHAYVRAKLMDTYPSHISPTGCLPAHLLGDMWGRFWTNLYPLTVPFGQKPNIDVTDTMVNQSWDARRIFEEAEKFFVSVGLPNMTQGFWENSMLTEPGDGRKVVCHPTAWDLGKHDFRIKMCTKVTMDDFLTAHHEMGHIQYDMAYAAQPFLLRNGANEGFHEAVGEIMSLSAATPKHLKNIGLLPPGFSEDSETDINFLFKQALTIVGTLPFTYMLEKWRWMVFKGEIPKEQWIKKWWEMKRDLVGVVEPLPHDETYCDPASLFHVANDYSFISQMLKLGRSKPWTLALYNVVGAKNMDVRPLLNYFDPLFTWLKEQNRNSFVGWNTDWSPYADQSIKVRISLKSALGEKAYKWNDNEMYLFRSSIAYAMREYFSKVKNQMIPFVEDNVWVNDLKPRISFTFFVTLPGNVSDIIPRADVEEAIRMSRGRINDAFRLDDKSLEFLGIQPTLGPPYQPPVTIWLIVFGAVMGVVVVGIVLLIFSGIRNRRKNDQARSEENPYASVNLSKGENNPGFQNVGAVQTSF

SEQ ID NO: 115 - protein, 805 aa, Suricata suricatta
MSGSFWLLLSFAALTAAQSTTEELAKTFLEQFNHEAQELSYLSSVASWNYNTNITDENVKQMNEAGAKWSAFYEEQSKRAKAYPLAEIQNTTVKRQLQALQQSGSSVLSPEKGQRLNTILNAMSTIYSTGKACNPNNPQECLFLEPGLDNIMENSRDYNERLWAWEGWRAEVGKQLRPLYEEYVALKNEMARANNYEDYGDYWRGDYEEEGADGYNYSRSQLIKDVERTFTQIKPLYVHLHAYVRRKLMATYPSHISPTGCLPAHLLGDMWGRFWTNLYPLTVPFGDKPNIDVTDAMVNQGWDARRIFREAEKFFVSVGLPSMTQGFWDNSMLTEPGDGRKVVCHPTAWDLGKGDFRIKMCTKVTMDDFLTAHHEMGHIQYDMAYNAQPFLLRNGANEGFHEAVGEIMSLSAATPNHLKTIGLLSPAFSEDSETEINFLLKQALTIVGTLPFTYMLEKWRWMVFKGEIPKEQWMQKWWEMKRDIVGVVEPVPHDETYCDPASLFHVANDYSFIRYYTRTIYQFQFQEALCRIAKHQGPLHKCDISNSTEAGKKLLQMLSLGKSKPWTYALEQVVGAKNMDERPLLNYFEPLFTWLKEQNRNSFVGWNTEWFPHADQSIKVRISLKSALGEKAYEWNDNEMYLFRSSIAYAMREYFNKEKKQTIPFVEDNVWVTNLKPRISFNFFVTSYKNVSDIIPRSEVEAAIRMSRSRINDAFRLDDNSLEFLGIQPTLSPPYQPPVTIWLIVFGVVMGVVVVGIVLLIVSGIRSRKKKTQARSDENPYASEDLSKGENNAGFQHVDDAQTSF

SEQ ID NO: 116 - protein, 805 aa, Paguma larvata
MSGSFWLLLSFAALTAAQSTTEELAKTFLETFNYEAQELSYQSSVASWNYNTNITDENAKNMNEAGAKWSAYYEEQSKLAQTYPLAEIQDAKIKRQLQALQQSGSSVLSADKSQRLNTILNAMSTIYSTGKACNPNNPQECLLLEPGLDNIMENSKDYNERLWAWEGWRAEVGKQLRPLYEEYVALKNEMARANNYEDYGDYWRGDYEEEWTGGYNYSRNQLIQDVEDTFEQIKPLYQHLHAYVRAKLMDTYPSRISRTGCLPAHLLGDMWGRFWTNLYPLTVPFGQKPNIDVTDAMVNQNWDARRIFKEAEKFFVSVGLPNMTQGFWENSMLTEPGDGRKVVCHPTAWDLGKGDFRIKMCTKVTMDDFLTAHHEMGHIQYDMAYAAQPFLLRNGANEGFHEAVGEIMSLSAATPNHLKTIGLLSPAFSEDNETEINFLLKQALTIVGTLPFTYMLEKWRWMVFKGAIPKEQWMQKWWEMKRNIVGVVEPVPHDETYCDPASLFHVANDYSFIRYYTRTIYQFQFQEALCQIAKHEGPLHKCDISNSTEAGKKLLEMLSLGRSEPWTLALERVVGAKNMNVTPLLNYFEPLFTWLKEQNRNSFVGWDTDWRPYSDQSIKVRISLKSALGEKAYEWNDNEMYLFRSSIAYAMREYFSKVKNQTIPFVEDNVWVSDLKPRISFNFFVTFSNNVSDVIPRSEVEDAIRMSRSRINDAFRLDDNSLEFLGIEPTLSPPYRPPVTIWLIVFGVVMGAIVVGIVLLIVSGIRNRRKNDQAGSEENPYASVDLNKGENNPGFQHADDVQTSF

SEQ ID NO: 117 - protein, 805 aa, Puma concolor
MSGSFWLLLSFAALTAAQSTTEELAKTFLEKFNHEAEELSYQSSLASWNYNTNITDENVQKMNEAGAKWSAFYEEQSKLAKTYPLAEIHNTTVKRQLQALQQSGSSVLSADKSQRLNTILNAMSTIYSTGKACNPNNPQECLLLEPGLDDIMENSKDYNERLWAWEGWRAEVGKQLRPLYEEYVALKNEMARANNYEDYGDYWRGDYEEEWTDGYNYSRSQLIKDVEHTFTQIKPLYQHLHAYVRAKLMDTYPSRISPTGCLPAHLLGDMWGRFWTNLYPLTVPFGQKPNIDVTDAMVNQSWDARRIFKEAEKFFVSVGLPNMTQGFWENSMLTEPGDSQKVVCHPTAWDLGKGDFRIKMCTKVTMDDFLTAHHEMGHIQYDMAYAVQPFLLRNGANEGFHEAVGEIMSLSAATPNHLKTIGLLSPGFSEDSETEINFLLKQALTIVGTLPFTYMLEKWRWMVFKGEIPKEQWMQKWWEMKREIVGVVEPVPHDETYCDPASLFHVANDYSFIRYYTRTIYQFQFQEALCRIAKHEGPLHKCDISNSIEAGKKLLQMLTLGKSKPWTLALEHVVGEKNMNVTPLLKYFEPLFTWLKEQNRNSFVGWNTDWRPYADQSIKVRISLKSALGDEAYEWNDNEMYLFRSSVAYAMREYFSKVKNQMIPFVEDNVWVSNLKPRISFNFFVTASKNVSDVIPRSEVEEAIRMSRSRINDAFRLDDNSLEFLGIQPTLSPPYQPPVTIWLIVFGVVMGVVVVGIVLLIVSGIRNRRKNNQARSEENPYASVDLSKGENNPGFQHADDVQTSF

SEQ ID NO: 118 - protein, 805 aa, Felis catus
MSGSFWLLLSFAALTAAQSTTEELAKTFLEKFNHEAEELSYQSSLASWNYNTNITDENVQKMNEAGAKWSAFYEEQSKLAKTYPLAEIHNTTVKRQLQALQQSGSSVLSADKSQRLNTILNAMSTIYSTGKACNPNNPQECLLLEPGLDDIMENSKDYNERLWAWEGWRAEVGKQLRPLYEEYVALKNEMARANNYEDYGDYWRGDYEEEWTDGYNYSRSQLIKDVEHTFTQIKPLYQHLHAYVRAKLMDTYPSRISPTGCLPAHLLGDMWGRFWTNLYPLTVPFGQKPNIDVTDAMVNQSWDARRIFKEAEKFFVSVGLPNMTQGFWENSMLTEPGDSRKVVCHPTAWDLGKGDFRIKMCTKVTMDDFLTAHHEMGHIQYDMAYAVQPFLLRNGANEGFHEAVGEIMSLSAATPNHLKTIGLLSPGFSEDSETEINFLLKQALTIVGTLPFTYMLEKWRWMVFKGEIPKEQWMQKWWEMKREIVGVVEPVPHDETYCDPASLFHVANDYSFIRYYTRTIYQFQFQEALCRIAKHEGPLHKCDISNSSEAGKKLLQMLTLGKSKPWTLALEHVVGEKKMNVTPLLKYFEPLFTWLKEQNRNSFVGWNTDWRPYADQSIKVRISLKSALGDEAYEWNDNEMYLFRSSVAYAMREYFSKVKNQTIPFVEDNVWVSNLKPRISFNFFVTASKNVSDVIPRSEVEEAIRMSRSRINDAFRLDDNSLEFLGIQPTLSPPYQPPVTIWLIVFGVVMGVVVVGIVLLIVSGIRNRRKNNQARSEENPYASVDLSKGENNPGFQHADDVQTSF

SEQ ID NO: 119 - protein, 805 aa, Lynx canadensis
MSGSFWLLLSFAALAAAQSTTEELAKTFLEKFNHEAEELSYQSSLASWNYNTNITDENVQKMNEAGAKWSAFYEEQSKLAKTYPLAEIHNTTIKRQLQALQQSGSSVLSADKSQRLNTILNAMSTIYSTGKACNPNNPQECLLLEPGLDDIMENSKDYNERLWAWEGWRAEVGKQLRPLYEEYVALKNEMARANNYEDYGDYWRGDYEEEWTDGYNYSRSQLIKDVEHTFTQIKPLYQHLHAYVRAKLMDTYPSRISPTGCLPAHLLGDMWGRFWTNLYPLTVPFGQKPNIDVTDAMVNQSWDARRIFKEAEKFFVSVGLPNMTQGFWENSMLTEPGDSRKVVCHPTAWDLGKGDFRIKMCTKVTMDDFLTAHHEMGHIQYDMAYAVQPFLLRNGANEGFHEAVGEIMSLSAATPNHLKTIGLLSPGFSEDSETEINFLLKQALTIVGTLPFTYMLEKWRWMVFKGEIPKEQWMQKWWEMKREIVGVVEPVPHDETYCDPASLFHVANDYSFIRYYTRTIYQFQFQEALCRIAKHEGPLHKCDISNSSEAGKKLLQMLTLGKSKPWTLALEHVVGEKNMNVTPLLKYFEPLFTWLKEQNRNSFVGWNTDWRPYADQSIKVRISLKSALGDEAYEWNDNEMYLFRSSVAYAMREYFSKVKNQTIPFVEDNVWVSNLKPRISFNFFVTASKNVSDVIPRSEVEEAIRMSRSRINDAFRLDDNSLEFLGIQPTLSPPYQPPVTIWLIVFGVVMGVVVVGIVLLIVSGIRNRRKNNQARSEENPYASVDLSKGENNPGFQHADDVQTSF

SEQ ID NO: 120 - protein, 805 aa, Manis javanica
MSGSSWLLLSLVAVTAAQSTSDEEAKTFLEKFNSEAEELSYQSSLASWNYNTNITDENVQKMNVAGAKWSTFYEEQSKIAKNYQLQNIQNDTIKRQLQALQLSGSSALSADKNQRLNTILNTMSTIYSTGKVCNPGNPQECSLLEPGLDNIMESSKDYNERLWAWEGWRSEVGKQLRPLYEEYVVLKNEMARANHYEDYGDYWRGDYEAEGANGYNYSRDHLIEDVEHIFTQIKPLYEHLHAYVRAKLMDNYPSHISPTGCLPAHLLGDMWGRFWTNLYPLTVPFRQKPNIDVTDAMVNQTWDANRIFKEAEKFFVSVGLPKMTQTFWENSMLTEPGDGRKVVCHPTAWDLGKHDFRIKMCTKVTMDDFLTAHHEMGHIQYDMAYAMQPYLLRNGANEGFHEAVGEIMSLSAATPKHLKNIGLLPPDFYEDNETEINFLLKQALTIVGTLPFTYMLEKWRWMVFSGQIPKEQWMKKWWEMKREIVGVVEPVPHDETYCDPASLFHVANDYSFIRYYTRTIYQFQFQEALCQTAKHEGPLHKCDISNSAEAGQKLLQMLSLGKSKPWTLALERVVGTKNMDVRPLLNYFEPLLTWLKEQNKNSFVGWNTDWSPYAAQSIKVRISLKSALGEKAYEWNDSEMYLFRSSVAYAMREYFSKVKKQTIPFEDECVRVSDLKPRVSFIFFVTLPKNVSAVIPRAEVEEAIRISRSRINDAFRLDDNSLEFLGIQPTLQPPYQPPVTIWLIVFGVVMGVVVVGIVVLIFTGIRDRKKKDQARSEQNPYASVDLSKGENNPGFQNVDDVQTSF

SEQ ID NO: 121 - protein, 805 aa, Equus caballus
MSGSSWLLLSLVAVTAAQSTTEDLAKTFLEKFNSEAEELSHQSSLASWSYNTNITDENVQKMNEAGARWSAFYEEQCKLAKTYPLEEIQNLTVKRQLQALQQSGSSVLSADKSKRLNEILNTMSTIYSTGKVCNPSNPQECLLLEPGLDAIMENSKDYNQRLWAWEGWRSEVGKQLRPLYEEYVVLKNEMARANNYEDYGDYWRGDYEAEGPSGYDYSRDQLIEDVERTFAEIKPLYEHLHAYVRAKLMDTYPSHINPTGCLPAHLLGDMWGRFWTNLYSLTVPFGQKPNIDVTDAMVDQSWDAKRIFEEAEKFFVSVGLPNMTQGFWENSMLTEPGDGRKVVCHPTAWDLGKGDFRIKMCTKVTMDDFLTAHHEMGHIQYDMAYAVQPYLLRNGANEGFHEAVGEIMSLSAATPNHLKAIGLLPPDFYEDSETEINFLLKQALTIVGTLPFTYMLEKWRWMVFKGEIPKEEWMKKWWEMKREIVGVVEPVPHDETYCDPAALFHVANDYSFIRYYTRTIYQFQFQEALCQTAKHEGPLHKCDISNSTEAGQKLLQMLSLGKSEPWTLALERIVGVKNMDVRPLLNYFEPLFTWLKDQNKNSFVGWSTNWSPYADQSIKVRISLKSALGEKSYEWNDNEMYLFQSSVAYAMRVYFLKAKNQTILFGEEDVWVSDLKPRISFNFFVTSPKNASDIIPRTDVEEAIRMSRSRINDAFRLDDNTLEFLGIQPTLGPPYQPPVTVWLIAFGVVMGLVVVGIVVLIATGIRGRRKKNQARSEENPYASVDLSKGENNPGFQNGDDVQTSF

SEQ ID NO: 122 - DNA, 395 bp, Artificial Sequence
  Description of Artificial Sequence: Synthetic polynucleotide
  CDS (262)..(357)
cacctggagacacatccacactgttttgacctccatagcagacaccaggaccaatccagcctcaagacagattcaggaactgaaaaaccagaaagttaacaggtaagtttaaagctcagggcaagactgggcctttgcctgggtctggtggtggtgcaaatcaaagaactgctcctcacatttttttccttttcttccaggcctgtaaggaagtgttacttctactctaaaagctgaggaattgtagagctagcagccaccatgcctatgggctcactacagccattggccaccctgtatctcctgggaatgctggttgccagtgtgctggcccagtccaccattgaggaacaggtcaagacattcctggacaagtttaaccacgaagccgaaga

SEQ ID NO: 123 - DNA, 280 bp, Artificial Sequence
  Description of Artificial Sequence: Synthetic polynucleotide
  modified_base (1)..(3): a, c, t, g, unknown or other
  modified_base (6)..(6): a, c, t, g, unknown or other
  modified_base (9)..(10): a, c, t, g, unknown or other
  modified_base (19)..(20): a, c, t, g, unknown or other
  modified_base (72)..(72): a, c, t, g, unknown or other
  modified_base (74)..(78): a, c, t, g, unknown or other
nnnggncgnnctcggatcnnctagtaacggccgccagtgtgctggaattcgcccttccatagcagacaccangnnnnntccagcctcaagacagattcaggaactgaaaaaccagaaagttaacaggcctgtaaggaagtgttacttctactctaaaagctgaggaattgtagagctagcagccaccatgcctatgggctcactacagccattggccaccctgtatctcctgggaatgctggttgccagtgtgctggcccagtccaccattgaggaacag

SEQ ID NO: 124 - protein, 32 aa, Artificial Sequence
  Description of Artificial Sequence: Synthetic polypeptide
MPMGSLQPLATLYLLGMLVASVLAQSTIEEQV

SEQ ID NO: 125 - protein, 961 aa, Artificial Sequence
  Description of Artificial Sequence: Synthetic polypeptide
MSSSSWLLLSLVAVTAAQSTIEEQVKTFLDKFNHEAEDLFYQCSLASWNYNTNITEENVQNMNNACDKWSAFLCEQSTLAQMYPLQEIQDLTVKLQLQALQQNGSCVLSEDKSKRLNTILNTMSTIYCTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPTGPLPAHLLGDMWGRFWTNLYSLTVPFGQKPNIDVTDAMVDQAWDAQRIFKEAEKFFVSVGLPNMTQGFWENSMLTDPGNGQKVCCYPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYMDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDITPRTEVEKAIRMSRSRINDCFRLNDNSLEFLGIQPTLGPPNQPPVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVLHEALHSHYTQKSLSLSPGK

SEQ ID NO: 126 - DNA, 3565 bp, Artificial Sequence
  Description of Artificial Sequence: Synthetic polynucleotide
gagctcacttagtgaactgtcagatcacctggagacacatccacactgttttgacctccatagcagacaccaggaccaatccagcctcaagacagattcaggaactgaaaaaccagaaagttaacaggtaagtttaaagctcagggcaagactgggcctttgcctgggtctggtggtggtgcaaatcaaagaactgctcctcacatttttttccttttcttccaggcctgtaaggaagtgttacttctactctaaaagctgaggaattgtagagctagcagccaccatgtcaagctctagctggctcctgctcagccttgtagctgtaacagcagcacagagcaccattgaagaacaagtcaaaacattcctggacaaattcaaccatgaagctgaagacctgttctaccaatgctcactggcaagctggaactacaacacaaacatcacagaagagaatgtccaaaacatgaacaatgcatgtgacaaatggagtgcattcctctgtgaacaaagcacactggcccaaatgtacccactccaagaaatccaagacctgacagtcaagctgcagctgcaggcactgcagcagaatggaagctgtgtactgagtgaagacaaatccaaaagactaaacacaatactaaacacaatgagcacaatctactgcacaggaaaagtatgcaacccagacaatccacaagaatgcctgctgctggaaccaggactcaatgaaatcatggccaactcactagactacaatgaaagactctgggcatgggaaagctggagatcagaagtaggcaaacaactcagaccactctatgaagaatatgtagtcctcaaaaatgaaatggcaagagcaaaccactatgaagactatggagactactggagaggagactatgaagtaaatggagtagatggctatgactactcaagaggacaactaatagaagatgtagaacacacatttgaagaaatcaaaccactctatgaacacctccatgcatatgtaagagcaaaactcatgaatgcctacccatcatacatcagcccaacaggaccactaccagcacacctactaggagacatgtggggaagattctggacaaacctgtacagcctgacagtaccatttggacagaaaccaaacatagatgtcacagatgcaatggtagaccaagcctgggatgcacagagaatattcaaagaagcagaaaaattctttgtatctgtgggactccccaacatgacacaaggattctgggaaaactccatgctgacagacccaggaaatggccagaaagtatgctgctacccaacagcctgggacctaggcaaaggagacttcagaatcctgatgtgcaccaaagtcacaatggatgacttcctgacagcccaccatgaaatgggccacatccaatatgacatggcatatgcagcacaaccattcctactaagaaatggagccaatgaaggattccatgaagcagtaggagaaatcatgtcactgagtgcagccacacccaagcacctgaaaagcattggactgctgagcccagacttccaagaagacaatgaaacagaaataaacttcctactaaaacaagcactgacaattgtaggaaccctgccattcacctacatgctggaaaaatggagatggatggtcttcaaaggagaaatcccaaaagaccagtggatgaaaaaatggtgggaaatgaaaagagaaatagtaggagtagtagaaccagtaccacatgatgaaacatacatggacccagcatcactattccatgtatcaaatgactacagcttcataagatactacacaagaacactgtaccaattccaattccaagaagcactatgccaagcagccaagcatgaaggcccactgcacaaatgtgacatcagcaactccacagaagcaggacagaagctcttcaacatgctgagactgggaaaatcagaaccatggaccctggcactggaaaatgtagtaggagccaagaacatgaatgtaagaccactcctcaactactttgaaccactcttcacatggctcaaagaccaaaacaagaattcatttgtaggatggagcacagactggagcccatatgctgatcaaagcatcaaggtaagttgaaagctcagggggagactgggcctttgtctggggctcccttggagcctacctagactcagctggctctccaggctttgcctgaccctgcttgctcaactctagttaactgtggagggcagtgtagtctgagcagtacttgttgctgctgggggggccaccagacataatagctgacagactaacagactgttcctttccttttttctttcctgcaggtaagaatctcactaaaatcagcactaggagacaaagcctatgaatggaatgacaatgagatgtacctgtttagaagctctgtagcctatgccatgagacaatacttcctgaaagtcaaaaaccagatgatcctgtttggagaagaagatgtcagagtagccaatctgaagcctagaatcagcttcaacttctttgtaactgcacctaagaatgtatcagacatcactccaagaacagaagtagaaaaagccatcagaatgagcagaagcagaatcaatgactgcttcagactgaatgacaacagcctggagttcctgggaatccagcctacactgggaccaccaaaccaaccaccagtagaatgtccaccatgtccagcaccaccagtagcaggaccaagtgtattcctattcccaccaaagccaaaagacacactaatgatatctagaacacctgaagtgacctgtgtagtagtagatgtatcccatgaagaccctgaagtccaattcaattggtatgtggatggagtggaagtacacaatgccaagaccaaaccaagagaagagcaattcaatagcacattcagagtagtatctgtactcactgtagtgcaccaagactggctcaatggcaaagaatacaaatgcaaagtgtccaacaaaggactccctgcaccaattgaaaagactatctccaagaccaaaggacaaccaagagagccacaagtctacacactgccaccaagtagagaagagatgaccaagaaccaagtatcactgacatgccttgtcaaaggattctaccctagtgacattagtgtagaatgggaaagtaatggacaacctgaaaacaactacaagacaacaccaccaatgctggatagtgatggcagcttcttcctgtactcaaaactgactgtagacaaaagtagatggcaacaaggaaatgtgtttagctgttctgtactgcatgaagcactgcacagccactacacacaaaaaagcctgagtctgagccctggcaagtgataggatccagatctgctgtgccttctagttgcagccatctgttgtttgcccctcccccgtgccttccttgaccctggaagtgccactcccactgtcctttcctaataaaagaggaaattgcatcgcattgtctgagtagtgtcattctattctggggggtggggtgggg

SEQ ID NO: 127 - protein, 961 aa, Artificial Sequence
  Description of Artificial Sequence: Synthetic polypeptide
MSSSSWLLLSLVAVTAAQSTIEEQAKTFLDKFNHEAEDLFYQCSLASWNYNTNITEENVQNMNNACDKWSAFLCEQSTLAQMYPLQEIQDLTVKLQLQALQQNGSCVLSEDKSKRLNTILNTMSTIYCTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPTGPLPAHLLGDMWGRFWTNLYSLTVPFGQKPNIDVTDAMVDQAWDAQRIFKEAEKFFVSVGLPNMTQGFWENSMLTDPGNGQKVCCYPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYMDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDITPRTEVEKAIRMSRSRINDCFRLNDNSLEFLGIQPTLGPPNQPPVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVLHEALHSHYTQKSLSLSPGK

SEQ ID NO: 128 - DNA, 3565 bp, Artificial Sequence
  Description of Artificial Sequence: Synthetic polynucleotide
gagctcacttagtgaactgtcagatcacctggagacacatccacactgttttgacctccatagcagacaccaggaccaatccagcctcaagacagattcaggaactgaaaaaccagaaagttaacaggtaagtttaaagctcagggcaagactgggcctttgcctgggtctggtggtggtgcaaatcaaagaactgctcctcacatttttttccttttcttccaggcctgtaaggaagtgttacttctactctaaaagctgaggaattgtagagctagcagccaccatgtcaagctctagctggctcctgctcagccttgtagctgtaacagcagcacagagcaccattgaagaacaagccaaaacattcctggacaaattcaaccatgaagctgaagacctgttctaccaatgctcactggcaagctggaactacaacacaaacatcacagaagagaatgtccaaaacatgaacaatgcatgtgacaaatggagtgcattcctctgtgaacaaagcacactggcccaaatgtacccactccaagaaatccaagacctgacagtcaagctgcagctgcaggcactgcagcagaatggaagctgtgtactgagtgaagacaaatccaaaagactaaacacaatactaaacacaatgagcacaatctactgcacaggaaaagtatgcaacccagacaatccacaagaatgcctgctgctggaaccaggactcaatgaaatcatggccaactcactagactacaatgaaagactctgggcatgggaaagctggagatcagaagtaggcaaacaactcagaccactctatgaagaatatgtagtcctcaaaaatgaaatggcaagagcaaaccactatgaagactatggagactactggagaggagactatgaagtaaatggagtagatggctatgactactcaagaggacaactaatagaagatgtagaacacacatttgaagaaatcaaaccactctatgaacacctccatgcatatgtaagagcaaaactcatgaatgcctacccatcatacatcagcccaacaggaccactaccagcacacctactaggagacatgtggggaagattctggacaaacctgtacagcctgacagtaccatttggacagaaaccaaacatagatgtcacagatgcaatggtagaccaagcctgggatgcacagagaatattcaaagaagcagaaaaattctttgtatctgtgggactccccaacatgacacaaggattctgggaaaactccatgctgacagacccaggaaatggccagaaagtatgctgctacccaacagcctgggacctaggcaaaggagacttcagaatcctgatgtgcaccaaagtcacaatggatgacttcctgacagcccaccatgaaatgggccacatccaatatgacatggcatatgcagcacaaccattcctactaagaaatggagccaatgaaggattccatgaagcagtaggagaaatcatgtcactgagtgcagccacacccaagcacctgaaaagcattggactgctgagcccagacttccaagaagacaatgaaacagaaataaacttcctactaaaacaagcactgacaattgtaggaaccctgccattcacctacatgctggaaaaatggagatggatggtcttcaaaggagaaatcccaaaagaccagtggatgaaaaaatggtgggaaatgaaaagagaaatagtaggagtagtagaaccagtaccacatgatgaaacatacatggacccagcatcactattccatgtatcaaatgactacagcttcataagatactacacaagaacactgtaccaattccaattccaagaagcactatgccaagcagccaagcatgaaggcccactgcacaaatgtgacatcagcaactccacagaagcaggacagaagctcttcaacatgctgagactgggaaaatcagaaccatggaccctggcactggaaaatgtagtaggagccaagaacatgaatgtaagaccactcctcaactactttgaaccactcttcacatggctcaaagaccaaaacaagaattcatttgtaggatggagcacagactggagcccatatgctgatcaaagcatcaaggtaagttgaaagctcagggggagactgggcctttgtctggggctcccttggagcctacctagactcagctggctctccaggctttgcctgaccctgcttgctcaactctagttaactgtggagggcagtgtagtctgagcagtacttgttgctgctgggggggccaccagacataatagctgacagactaacagactgttcctttccttttttctttcctgcaggtaagaatctcactaaaatcagcactaggagacaaagcctatgaatggaatgacaatgagatgtacctgtttagaagctctgtagcctatgccatgagacaatacttcctgaaagtcaaaaaccagatgatcctgtttggagaagaagatgtcagagtagccaatctgaagcctagaatcagcttcaacttctttgtaactgcacctaagaatgtatcagacatcactccaagaacagaagtagaaaaagccatcagaatgagcagaagcagaatcaatgactgcttcagactgaatgacaacagcctggagttcctgggaatccagcctacactgggaccaccaaaccaaccaccagtagaatgtccaccatgtccagcaccaccagtagcaggaccaagtgtattcctattcccaccaaagccaaaagacacactaatgatatctagaacacctgaagtgacctgtgtagtagtagatgtatcccatgaagaccctgaagtccaattcaattggtatgtggatggagtggaagtacacaatgccaagaccaaaccaagagaagagcaattcaatagcacattcagagtagtatctgtactcactgtagtgcaccaagactggctcaatggcaaagaatacaaatgcaaagtgtccaacaaaggactccctgcaccaattgaaaagactatctccaagaccaaaggacaaccaagagagccacaagtctacacactgccaccaagtagagaagagatgaccaagaaccaagtatcactgacatgccttgtcaaaggattctaccctagtgacattagtgtagaatgggaaagtaatggacaacctgaaaacaactacaagacaacaccaccaatgctggatagtgatggcagcttcttcctgtactcaaaactgactgtagacaaaagtagatggcaacaaggaaatgtgtttagctgttctgtactgcatgaagcactgcacagccactacacacaaaaaagcctgagtctgagccctggcaagtgataggatccagatctgctgtgccttctagttgcagccatctgttgtttgcccctcccccgtgccttccttgaccctggaagtgccactcccactgtcctttcctaataaaagaggaaattgcatcgcattgtctgagtagtgtcattctattctggggggtggggtgggg

SEQ ID NO: 129 - protein, 961 aa, Artificial Sequence
  Description of Artificial Sequence: Synthetic polypeptide
MSSSSWLLLSLVAVTAAQSTIEEQVKTFLDKFNHEAEDLFYQCSLASWNYNTNITEENVQNMNNACDKWSAFLKEQSTLAQMYPLQEIQDLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPTGPLPAHLLGDMWGRFWTNLYSLTVPFGQKPNIDVTDAMVDQAWDAQRIFKEAEKFFVSVGLPNMTQGFWENSMLTDPGNGQKVVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYMDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDITPRTEVEKAIRMSRSRINDCFRLNDNSLEFLGIQPTLGPPNQPPVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVLHEALHSHYTQKSLSLSPGK

SEQ ID NO: 130 - protein, 961 aa, Artificial Sequence
  Description of Artificial Sequence: Synthetic polypeptide
MSSSSWLLLSLVAVTAAQSTIEEQAKTFLDKFNHEAEDLFYQCSLASWNYNTNITEENVQNMNNACDKWSAFLKEQSTLAQMYPLQEIQDLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPTGPLPAHLLGDMWGRFWTNLYSLTVPFGQKPNIDVTDAMVDQAWDAQRIFKEAEKFFVSVGLPNMTQGFWENSMLTDPGNGQKVVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYMDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDITPRTEVEKAIRMSRSRINDCFRLNDNSLEFLGIQPTLGPPNQPPVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVLHEALHSHYTQKSLSLSPGK

What is claimed is:

1. A fusion protein comprising a human angiotensin-converting enzyme 2 (ACE2) mutein and an antibody Fc domain, wherein the human ACE2 mutein comprises an amino acid sequence at least 80% identical to amino acids 19-615 of wild-type human ACE2 (SEQ ID NO: 1), wherein the fusion protein has a melting temperature of at least 60° C. in a differential scanning fluorimetry (DSF) assay, and wherein the ACE2 mutein is not identical to a wild-type ACE2 of a non-human animal.

2. The fusion protein of claim 1, comprising:
   a. two or more substitutions of a non-cysteine amino acid in wild-type human ACE2 (SEQ ID NO: 1) to a cysteine amino acid;
   b. two or more amino acid substitutions, which are disposed on opposite sides of the angiotensin II substrate-binding cleft of the ACE2 mutein; and/or
   c. one or more amino acid substitutions, which increase the volume of buried hydrophobic amino acids and/or decrease the volume of exposed or partially-exposed hydrophobic amino acids in comparison to wild-type human ACE2 (SEQ ID NO:1).

3. The fusion protein of claim 2, wherein one of said cysteine amino acids is disposed on one side of the angiotensin II substrate-binding cleft of the ACE2 mutein and the other one of said cysteine amino acids is disposed on the opposite side of the cleft, wherein said cysteine amino acid substitutions form a disulfide bond.

4. The fusion protein of claim 1, comprising the substitutions S43C/G66C, K74C/S106C, S128C/V343C, and/or A714C of wild-type human ACE2 (SEQ ID NO: 1).

5. The fusion protein of claim 1, comprising at least one substitution at position H345 or F504.

6. The fusion protein of claim 1, wherein said ACE2 mutein comprises the substitution H345Y.

7. The fusion protein of claim 1, comprising one or more substitutions at a position corresponding to I259, C261, V339, A342, and/or C498 of SEQ ID NO: 1.

8. The fusion protein of claim 7, comprising one or more of the substitutions I259T, C261P, V339G, A342V, and/or C498M.

9. The fusion protein of claim 1, wherein the ACE2 mutein comprises a collectrin domain having an amino acid sequence at least 80% identical to the collectrin domain of wild-type human ACE2 (SEQ ID NO: 1) amino acids 616-723.

10. The fusion protein of claim 1, comprising one or more substitutions at a position corresponding to V620, I622, A650, L656, M662, L664, V685, and I695 of SEQ ID NO: 1.

11. The fusion protein of claim 10, comprising one or more of the substitutions V620I, I622L, A650V, A650I, L656S, M662G, M662D, L664G, L664P, V685L, and/or I695T.

12. The fusion protein of claim 1, comprising a substitution at one or more of the positions corresponding to N90, L91, and T92.

13. The fusion protein of claim 12, comprising the substitution N90D.

14. The fusion protein of claim 1, comprising the substitution A25V.

15. A nucleic acid encoding the fusion protein of claim 1.

16. A cell comprising the nucleic acid of claim 15.

17. A composition comprising the fusion protein of claim 1.

18. The fusion protein of claim 1, wherein the melting temperature is between 60° C. and 70° C.

19. The fusion protein of claim 1, wherein the melting temperature is between 60° C. and 65° C.

* * * * *